United States Patent 12,790,634 (MOST PROBABLE NUMBER ANALYSIS OF HETEROGENOUS POPULATIONS) - sequence listing, part 28

SEQ ID NO: 18 - DNA, 3616449 bp, unidentified (residues 1-1,808,225 of 3,616,449)
  source 1..3616449: mol_type = genomic DNA; note = Thomasclavelia ramosa
aaaagaaacttaatttttctaagatactccaggatggaataaaaaaagaactcggtatttaaatgataatgactaggctaaaatagctgggagggtacatttctagtgaaaaaagtaatactaataattattaatctgatactggttgtaatgctgacaggctgttcaacagctgaatctgagcctgcaggtactaataataccaatgataagacacagttaataactgaaaatataccagattacacagacaaaatttatgtggaaattaatggaaataaagcagaattcagtgatgaagataaaaaacgaacagatgcttttgaactgtacactgatttagacgaatttgggcgctgcggtgttgcatatgcaaatatatgtaaggaattaatgcctactgaaaagagaggctcaattgggatgataaaaccatctggatggcagcttgctaaatatgattcggttgatggaaaatatttatacaatagatcacacttgattggatttcaactggcaggtgaaaatgccaatgaaaagaacctgatcacgggaacaagatattttaatgtagtgggtatgcttccgtttgaaaatgaagtagctgaatatgttaaagaaacgaataatcatgttttgtatagagttacacctgttttcaaagatacagaactggttgccagaggtgttaaaatagaagcatattcagttgaagacagtggtgaaggtgtagaatttaatgtatttgtctataatgttcagcctgatattgcgatcaattaccaggatggaacaagcagcggaagcggtcagattgtagacggtgtagttaaagataaagagactcatgattctgaagcagtaatagggaataaaaatactagagtatatcacgataatgactgcggttctcttcctaaggaggaaaatcgtacatattttggcagtgaaaatgaagcagtagatgcagggtatactccgcataacagttgtattaattaaatatgaaaaccttaatttgtcagttaaaagtaaataattaatgtttgagtgtgtagttcagttgaattacgcacttttaaattttataatcgttttagaatcagtttaattattaatgatgtgttaataattaaattaaaggcagttgaggtgagaatgatgagcgcagggaatatatatggctatagatctgaaagcgttttatgcttctgtagaatgtgtagaaagagaattagatccacatgaataccaatctggtggttgctgattcaactaaaacagaaaagacaatctgtttggctgtttctccttctcttaaacagtatggtatcggcggtagagcaaggctctttgaagtagttcaaaaggtcaaagaaatcaatagaaaaagaaaaaaagataacaggtatagggagtttagaggaaaatcacatattgattcagagttaaaaaatgacacaagtcttgaactgggattcattattgcccctccgaggatggcattttatattgattacagtaaaaaaatctacgaagtatatttagaatacacctcagctgaagatattcatgtttattcaattgatgaggtttttattgatgcaacgagctatcttaagactgttaataaatctccaagggaatttgcaaaaatgattattcaggatatttataagacaacgggaataacagtcacagcggaaataggaacaaatctatatcttgcgaaagtggcgatggatattgttgccaagcatgttaaagcagatgaagacggagtgcggattgcctgtttagatgaaatgagatatcggaaatacttatggcatcatcagccgattacagatttctggagagttggtaaaggatatgcaaaaaagcttaatgaagcggggttgtatactatgggtgatattgccaaatgttctgtaggcagtaaagacgagtattacaatgaagatcttctttatgatatgttcggagtcaatgctgaactgctgattgatcatgcatggggatacgaaccttgtacaatgaaacacatcaaggcatataaacctgaaagcagcagtctgggaagcggacaggttttaaacagaccgtatacctttaatgaaggaagaataattcttaaagaaatgattgactcgttgtgtctcgatcttgtggcaaaaaatctagtaacagatcagattacagtaagtgttggctatgataaagaaaatatcaaaactgactatactggcgaaataaaggatgacagatatggacgaaagattccaaaacatgctcatggaactgtcaatataggcagatatgcatcatcagcaaagctgatcacacaaaaagttttaaactggtatgacagcagtgttaataaaaaattaacaataagacgttttgctttgtctgctaatcatattactggtgaaagcagtattaaaacaaaaccgacaatacagcaaatggatctgtttactgattacgagcagttaaaaaaagaagaagaaaagcttgaaaaagatttagaaaaggaaaaaagacttcaggaagcaactttgaaactgaagcagaaatatggaaaaaatgctgtattaaaaggtatgaatttagtagttggagcaactggcaaagacagaaacaacactattgggggacataaagcgtgagtgatatacaattcgctataaatagtcgacgatgtaatacaataggtttataataaaacgtaagagttatagtaaaaaagggagaaatacctatatgaaaaaaatgtgttgtttgtggaaaggaatttaattctaaaaatggaataataaactgttcggatatatgttacgaaataagaaataaagaacgttaaaataatgggttgataggacagaataaattaaaaagagagcataagaaatgtcctgtatgcgggtaaaaatttgaggtaaaaaaagcaatcttgtctttgcgtggtctttcatttgcagattacgcacgtaagttaagaataacaccacaagccttaaatacaaaaaaagagaaataacgtttataaaataagtaatctgattgaatttggagaattgacgaatgcaaaattagtatttattgatgaagaaacaaatgaaattttgataaagtttaataaagaagatctaaatgaagaggaaaaataaaaaaagaatttttaagttgagcctgtaaattattttgtgtaaagtctatttcaatgatagaatttgatgagtaactgtattgagtaatcacacagttactttttttatatcatatcataatatatttaattgtaaatgttctcgttaaagcctcccttcaaaaatgatttgaagactagaatatataacacaccaattaccatatgagacattccatttacttgttattttatcctgagctaagtacaaagttttaaataaactttcagagagtgtaaataactccagtatataaaattctaactatttcacctgtctatttgacaagggggtatcaaatataatcgtaatacatgatttatctacttctgctttattaatgtaatgaattttatcataactggatttacacatgctttatatattacttcgttaacttctacatctttactctttatcttgacataaaatattttttaatttgcattaccatctattataaaattacttcttctataatcatatttgtgatctttaacttttctttccttcttatttcttgatgtgtaagatggaaataggaggttaacgattatgttccataaaaaatctatcttttaattatttaatgaagagtgaatttatatggattaattaaacatttgaatatgaatatatgaactaaaagatgaattattctgtataatcttatccacttattctataccttatagatatatattgtaattagtgaaacttttatttagagttttaattaacaatgttcagaattattattaacccaaataaaatgttcacatttttgttaaccatgtgtgtaatttccatcatgaataattcatgataatatttaaatgtaaagaagataaatcgtttggatccgagaaaattaattttcacgattatctgaggaaggagggaataaatgttttttgaggaaagggtagcattgttcggtgttgaagcctcatcttcagaagaggtaataaaaattgcagctgatgaattatataaaagaggtattgttaaagaggacttttatgaacacgtaatgctaagagagaaagagtttccaacaggattagcaacagctaagtatggagtcgcaattccacatacagactcaaaatatgttaatcgttcgcagattgaatttatatcattgaaatcaccagtaaagtttaaaaatatgggagatgtatcagaagatatagaagttactcatatttttatgattgcaatgagccaatcacatgaacagtctgaaacattaacgaaactcatgggaatgtttgctgatgaagagttgatgcagaaaatgtatgaatgttcttctaaggatgaatatgagagtattttacaagagaaaggattaatttaagtcgaggagaagaaatatgattgaaacatttatgaatatatttatgagcttaggttcttcggtatttattccagcaataattattatcttaggtttgatattaaaaatgaagccaggtaaagcgattgttgctgggttaacaattggtattggatttattggattaagtatggtcactggagtgatgacagatgctttaggaccagctattgaattaatggtcgaaaaatatggattatcattaagtattatggatttgggtagtggtaccgcaggaccagttgcattttcaacaacaatgggtatagttattattccgattgcatttgcaatcaacattgtattggtttatttaggattgacaaaaacattcaatgttgatgtttggaacttatggcaacctgcattaattggaattatggtgtggggaattacggatagttttttgattggtgttctttcaatgattccagcattcttaattgaattaattttagctgatttagcaactccatttatgactgatttctatggttttcctgggatgacatgtacacacattatggcaaatgcgggattggtattagccgtaccattaaattggttatttgataaaattccaggtttaaataaaattgaagtaaatcctgaaaaaattcaggaaaagtttggggtaattggtgatccaattataattggattcgtaattggtctaattattggtgcattagcaggatatgaagtacctaaaatgttgacattaggtgtacagatggctgcagtattaaaaattatgccaaaaatggtttcattatttatggaaggcttaacgcctgtcgcagatgcaactaaagaatttactgcaaaatatatgggtggtagagaggttaatattggaatggatgctgctttagtggttggtaattcatctgtaatgtctacggctttattaatgattccaattactcttttaattggtgttattcttccaggaaataaggtattaccatttggagatttaccaacattagtatttgcattagccttaatggttgcaggatttagaggaaatgtttttagaagtgtattaggatgttcaatttatactataactatgctttatgcagctacttatttagcaccagcattaactactgcttatcatattgcaggatatgaaattggtagtggtatgatttcttatgtatcagcaggattatggccaaatgcattgcttgtatttgttgctaacattttaagtgtaccaggattattaattttaacagcagttgcattaggcgtattatactatgtaaataaaattcgtaaagcgcaggcttaataaatagaggtgaaaaaaatgaaaagaattatgattatatgtggtgcaggacatgcaacttcaacagtggtgagaactaaagttgaaagctggttaaaaaaagaaggattaactaatgaagttgaggtaatgcaatcttcaataagtgcacagacaaaagatattgctgagggaaaatatgatattgtaattagcacaacacaagtaccagaaagcattaaagataaggttattatgggattgggacttttaactggttttgggactgaacaagtatttgcacaagtaaaagaaagactggggaaatagcatggcagtatttcataaagaaatcaatcttaccactatagctaatcgaccatcatatcatgatgttacagcagatgtaatggaagcattagctatcagtggcattcaggacgggatttgtgttgtatctagcccacatacaacttgtgcagtcttttttgaagaatttatgcatgacaagaattattatggtgacgaattcttacaagtcgatttgaatgaaactttagataaaattattccagtccaaacaacagaaggacaatatcatagtcctggtccagagcatattgcatatggtatggcaaaaacagatccggattatccagcaaaagaatggactatgttaaataccgatggacatttgagatctacattattaggagcaagtgaaacattgattattaaagatggaaacctattaaatggtaaagtaggttatatctattttgttgattttgatcaaacaagagaacgtagaagaaaatgtaatattgtcattatgggagaataaaaatgattaaaaatattattaaaaatgttattgaagcggaaagtaatgaattaaaaaaattgacagaatcattagattatgatgtagtaaatacattgattgatagaattcaaaatataaaaggtaatatctttataactggatgtggtacatctgcaatggctgcaaaaaaaattgttcatactatgcaagtagtgaatcaaaaagttttctatttaaacccatcagatgcagtgcatggaggaattggagcgattggaaaagatgacattgtcattatgatttctaaaggaggaagtacaaatgagttatgttcttttttaggaaacctaaaaagcaaagaggccttcattgtatatgtaggagaaaatgaaaattcaacaattggaaaatcagcagatttattcttgaaaattaaaattgaaaaagagccagatgaatataatatgttggcaactgctagtacattagctactatttcagtttttgatgcgattgcaatatatatagaaaagaattcagctttctctcaaaaagtatttttggaaaatcacccaagtggtgatgtaggtgatcgcttgaacgccatcattaagtaatataaggaaaatcaagggatagattgactctatctcttcatgcttttatggaggaaattatgattatagcaccatcattattaaattcgaatatatatgatattcaagaaactgtaaaaatcgctaaaattgcaggagataattatttgcatatagatgttatggatggtaattttgtcccaatgcaagcttttggtggaaagatagtaactgatttaaaaaagaaaactgatttaatattagatgttcatttaatgattaataatccagagttacatatagaagaatataaagatgcagatattattacagttcatgaagaaagcactaaacaattgtataattgtttaaatcaaattaagaatcttggtataaaagcgggagtggctattaatccaggcactccagttaatacacttacagaggttttaaatttggtagatcaagtattagttatgacagtaaatccggcaatgttaggtgaaagatttataaaaaattctgtcaaaaaaataatggaattaaaagaaataaaggaaaacagtaattatttgtttgatattgaggcagatggaaatattaatgaagaaacaataatcctatgccatagttcaggtgcaaatatttttgtgtctggtggatatgtatttggtcacaataatcctgaattgagaattaagaaattgaaaaatatactcagtaatggtaaagttgaataaaggaatgattctatgaacccacggcaaataagtatatttaattatttattagaacaaaatgattatgtaactgcgaaaacaatttcaaaagaattcaatgtaacacctaaaacgatttatatagacataaatatattacaagaagaattgatagaatatgaattaagtattgataaaaaaactaattgtggcattttattagttggaactgatgagttaaaggcgaaagctcgttcaattattaattcttattatgaaggttctactaatctgggattagatgtagaaagtcgaagaaaacaattatttgttgatttggtattgtttggaaattcaatatcacttcaaaaaacttctgagcagtattatgtatctaaatcatcaatactatatgatttagagtttcttagaaagaaatttttaataaaatatcacgttaatattgaaacagattatgataaaaaaataaaattaacaggtacagaagaaaatatacaattggctattatcaatgcttttataaatacaattttaaaaaaggaaaaagaacaaacttatttgatatttaatgaaaaaattaatttggtaattaacagtatgcttgaaaacagtgtaattatagatttgaatggttttgctgattattatagacaggctttaaaaattactttatttattttttttactcgtattgaaaacggctttcatataaaaaaagatgaatactattttctagatgacttagactttatgaaaaattatccaattgcaaagggaatttctgattatcttgaagagcagttaaatataaagtgcaccaacgaagataaaatgacattagctaaatatctagcgtcgtatcgtataaaaagtaataaatcaaatgagggtgattataaggaagttgtgaatagaattatcaactgtttagaaaaaattgaaaatatatgtattaaaaacagagaagaattgactaaccagttgttattacatataccatcaatggtattgagattaaaaaatggaattaagattgaaaatccattattagatgaaattaaatcaaggtaccttcacctatttactttatcttggtatttattatcaacaattgaaacagaatataatattagtttgacagaagatgaaatatcttttattgtaatttattttcaaatggcaattaataaatcatcagactcacgtagaatattagtagtttgtccttatggaattgtatcttcaaaatatgttgtttcacaattaaaaaatgtacttccaaaatatgatgatatacaagcatgtggatatgaggatttgaaaaacaaaaaattagataatttagacttaattgtgagcacttcatcacaaaaaatcgatacatcagttccagttgttcatgtaagtccaatgttagataatgttgattgtgcaaaaatatttgatgcttattcgaaatatgtttttttgacatcaactagaattggagagatttttaatcaaaataatatcaatattccattattaaggcatcatataaaaaaagaaaatgttttctttaaattggattttaatacaaaggaagattgtctcgattttatgattaaaaagttagagaaagacgatattgtgaaagaaggatttagaaaatctgtatacaaacgagaaaatattggaagtgcagttttagagaacggagtagctatacctcatgggctgcctacagaagtcaacgaaataggtctagttatattaacattaaaaagaccaatcagatggtcaactagttgggttgatatgattgttttgattgcagttccagaagataaaataattgaatttgaatctatggtgttagaattatatgaaatgatatctaatactgatgttcttgaggaaatcaaaaaaattaaatctatagatgagtgtactttcgagaagtaagtacattctataataaatgttttgaaactaatactgatcaaattgaaactaaatgattattcgtaaagtattaatagtttcttcttatttgttatggcaaatagagtagtgtatgtaattggagtggacgctttaaatatcgcggggtaattttaccccgctttaatttttacctgttcaaattgaaaatttgaacatatagacttaagtcagttgagcatacgaagtatgcgaaataaaaaaccacctgctatgcgggtggagcaataaagaagttatacaaagatatcacctttccgatataatggagttgttcaagctgtcattataagaaaggaaaggtgattaagtacggcacaaaaaacaaattcattggcacatacgaagtggatgtgtaaatatcacatcgtcttcacaccaaagtatagacgaaaagtgatatataatcaacttagaaatgatataagagaaataataataagattatgtcaatatagaggggtggaaattatagaggggcatttgatgtcagatcatgtacacatgttggtaatgataccaccaaagttaagtgtatcatcatttatggggtatttgaaaggtaagtcagcattaatgatatttgatcgacatgcaaatttgaaatataaatatggaaatagacatttttggtcagaaggatattatgtgagtacagtaggactaaatgatcaaacagtcgcaaaatatataagggaacaagagggacatgatatagcaatggataaattgagtgtaaaagaatatcaaaatccatttgaagataaagaaatgaagaaaaaaaacaaaaaagagagaagaagataacaaaaggagaaaggaggaaataaatccctttgagggatggcgagagtcaaaagcgatagcttgaacgaagagaaagcagcgccttgagacgcgagcaggcaacataggcttatagcctcagagaaaaccacgtcttttaggcgtggtttttattttatttacctgttcaaattgaaaatttgaacatatagacttaagtcagttgagcatacgaagtatgcgaaataaaaaaccacctgctatgcgggtggagcaataaagaagttatacaaagatatcacctttccgatataatggagttgttcaagctgtcattataagaaaggaaaggtgattaagtatggcacaaaaacaaattcattggcacatacgaagtggatgtgtaaatatcacatcgtcttcacaccaaagtatagacgaaaagtgatatataatcaacttagaaatgatataagagaaataataataagattatgtcaatataaaggggtggaaattatagaggggcatttgatgtcagatcatgtacacatgttggtaatgataccaccaaagttaagtgtatcatcatttatggggtatttgaaaggtaagtcagcattaatgatatttgatcgacatgcaaatttgaaatataaatatggaaatagacatttttggtcagaaggatattatgtgagtacagtaggactaaatgatcaaacagtcgcaaaatatataagggaacaagagggacatgatatagcaatggataaattgagtgtaaaagaatatcaaaatccatttgaagataaagaaatgaagaaagaaaacaaaaaagagagaagaagataacaaaaggagaaaggaggaaataaatccctttgagggatggcgagagtcaaaagcgatagcttgaacgaagagaaagcagcgccttgagacgcgagcaagcaacataggcttatagcctcagagaaaaccacgtcttttaggcgtggtttttattttaaaggtaaacggaagttcttttaaaaagtggtggtgaagtaattatcataagaaaaagaatagtttatagagaaaatgtctgcgcaagtgaaatttattttacgcataccgttataaaaaaacaattttacattaaatgatggctagaatgtataatttatgtgtttggtggaggtggtttgtttgaattcgtttattccatggataggtggaaaaaattattacgtaaagaaattataaaatgttttccaaaggaggattttacaaaatatgttgaggtgtttggcggagcaggatgggtgctttttgataaagtccaaagtaaaaaacaacttgaagtgttcaatgatatagatggtaatttaataaatttatacaggtgtattaagtttcatgctgatgcggtacaaaaagaacttgactggatcttatcatccagggaggtatttacagattataaagcgatgatagataacaatatcggtacagatattcaaaaagccgcaatgtatttatatttggtgaaagtatcatatggtgcggctcgcagaacatatggtgcaaaaacaggtataaataatactaaagagatactattagaaatacaaaaaagattatctgcagttattatagaaaataagaattatgaaaaaattataaaaagctatgacagtgctgatacactattttatcttgatccgccatattacaaagcggaacggcattatgattcacgatttactgtagaagatcataaagagcttgcaagaatattaaaggaaattagagggaggtttattttatcgtataataatgatccgtacattaaggaattatataaaggtttatatatcgaagaaatagaaagaaataataatctttctaacaaaaattgcaaatataaggaactgatcataaaaaattattaatgtcaataaaaattacgtaatacgtaattttttttcatttttctattaaaatttcaaataatgatagaattattccagggtgcatatcagatgataaaaatatatttatcaaaactgctgggtgaaagaagaataagtcagttagaacttgctcgtagaaccggaatacggcctgcaacaataaatgaaatatattgggagtttgcagaaagaataaatcttgaacacatagatcttatctgtaaaacgttaggatgtaggattgaagatttcatggaagttgtatatgaaaataatgatgaaaaaattaattgaatgtactctgaaaatgagtactttttttgtgggaggtaaagtaatgaataaaataaaatttaacgaaattattaatgagtatttatcttttaaaagaatgtatgttagacataatactatgattagctatgaagaaagaataaataattacatattgccttattttgctgatcgtgatattttttcgataaccaaagaagatatcataaattggcaaaaagatttatttgaaaaaggtgtgtctattaaatacataaataaaattcgaccagtgctgcataatatattttcttatttatgtgattatcatggctgcgataataatcctgttactcatgttcctaggttgagggataattcaccgtatgaagagatggatttttgggagtttgaagaatttaaaaaatttgctaaatcaattgatgatccactttattataggttttttatgtttttgtactatacaggtgctcgtaaaggtgaggcaagggcaatgacatggaaacaaatagattttaaaaataatttgattactatttccagaagtttagaacgaagaaaagataaaaatggaaattatataattaacagacctaaaaatggtcatagcaggactataatgttaaactctgaattaagagatgtgctattaacgtattattcagaacggaaaagacattttgattttgatgaaaaagagtatttgttcggaataaaaaaaccattggcggactctacaatagaaaacaggaagaataaatactgtgataaatctggtgttaagaaaataaggatacatgatttcagacatagcaacgtttcattgcttgtttcgttgggggcagatatatgtgttatctgttctcgtctgggacataaagatagaaatcagacacttaacagatattcgcatatgtttcctagtaaagaaggagaaatcgtggataaaattgataatcaagctagtatatataactcatattccgtaacattggcaaatattatagtagattttttagagaaaataaatcaattgaaaaatcttgaagaaaaagatataattatgatagagcaaataaagaaaattatgtaattataaacggataaaaatactgaaaggtatgatataatatctagtgtaaaagttagattagttagttgattttagataatattaaatggaatacagattccctggtggcttaacgaagctggaatgaaaaagagttattttcacattattttgtgacttcccttttttctcccattttttcgactcttttctgattttatttttttattaaatatagctattttattaaccgtcccttcttttttttaaagaattaaaaacaggtctatttttcaatacaacgcaaaaacatcatgtctgctgatattttatctgattcttcgccaaacgctcttattttaaataaaatgcctgtaccagctctgttagagtttactttatcgcctgcacgatcataaatatttttacctggtatattgtaattgactcatttaatagtcatctacaaatataccttctcctttctatcaaccatttaaaccgtggttgattacggttaagttaatttgtaaaatatttaatatgtaaatgtggatttgtatttttcaccttgtagcatgactactttaggcaggcccttaccacaaccttattcctaaataatgattagttagatgagttttgaattcgtattttgcaccaggttttgtggtctaagtgttgtggataccttttcacatatttttatcaagaaaggatcttttattatgaaattagttggtatcgatattggaaaaaaacacttcttttgtattatggacaaagatagtggtgaagttttacttcaaccttcttctttttccaatactaaagatggatttgattctctaatccaaaaacttagttcttattctaaggactctatattgattggtatggaagacaccgggcattatcattttgctttattaaagtatcttttagaaaaaaattttactgttgctcttatcaaccctaaaactactgattacactcgtaaaatgcagaacggcatcactaagaatgataaacttgacactcttactatctgtgatgttttggatactcctgtacgaaaaaagcagtatcgtattacaaaagtcaacagcttcgatctttatgaacaaaagcaattaactagacatcatcacaatttaaaagaagaactcaatgtttatacaaaccgcctacaaaaatgtattgatattgttttccctgaattcaacagcttattttcatctaaatacggcattatctacatgaatgtacttaaaacatttggcagtgctgaaaatatcgctagtactgatattagaactattcgcaaatgttttgaaataaaaggccgagggaaccgcatatctctaactgcacagcagcttaaagactctgctaaatcttctattggaatttcatcagcagcagaagtaatcaaaatcaaacatctgataagtcagattgaacttatcaatgaacagttagctgaaacagataaaaaaatagaagagttttccatccaaaataactctcctatcctatccatcccagggatttctcatttctctggtacttctattttagccgaattaggagagataagcaactattctaagccatctaagataataaaagcagctggtgttgctccttatcattacgaatcaagtcaatacgacgcacaacatactgctattaccaagaaaggttcaccatatttgagaaagactttatatcagatcatattgcctgtgattaataataataatccggtatttaaacaatattatgatttaaagatttctcaaggtaaaggtcatcgttgtgcttgtggacattgtgttagaaaattacttagaattatttatcatctttcaagtaccaatcaacaatttgatgatgcacttttaagataaaataaatgcattaaaattaaaaaaaggccaattttggttcttttcgtcatgcccaaaaattacaaatcattattcacatttcaaggatctatactacttaacatataaaatcatttattttaacattttttaactttttcataaaaacacttgaattttatatagttacctgccttagataatctatcctgatcctgcaggaaaaatcacaacagctgttattatcttaataacagctgataacccgggctgattaaaactatagcagtaagtcgatgatagacgacataattcatccagaactgcttatttttctttgcaattattatagattgcgctattatatttattaaagatggaggatgtggtatgaaagtattattaattaatggaagttttagaagaaatggctgtacttttacagctttgaatgaagttgctaaagcattaaatactaatggtattgatactgaaatatttcatattggaacaaaagctattaggggttgcatgggatgtggtgtttgccatgagaaaggtgaatgtatagataacagtgatgctgttaatgagtgtttaaaactatttgaagctgctgatggaattgtgataggaagtcctgttcattatgcaagctcttctggaatgattgcttcctttatggatcgtctattctatgcttcaagattcgataaacgttttaaagttggtgccactgtagttagttgtcgccgaggcggtgccagtgctacttttgatcaattaaataaatattttacaatcgctcaaatgccgattgtatcttcgcaatattggaatagcgtacatggtaatacacccgaagaagtaaaacaagattttgaaggaatgcagacaatgaaagtattaggtaataatatggcattcttactcaaaagtattgctttaggtaaagaaaaacatggtttacctgatgcagaactaaaaatagcaactaattttatcagataggagtattagaatgacacgaatttatttattacgtcatgggcaaactttatttaatcaaaaaaatctaatccaaggaagttgtgattctaaattaacagctaaaggaatagcccaggctaaagctgttaaggaatatttagatacaataaattttgcagctgtttattgttcaacaagtgaaaggacattggatactgcgacatatgcaactggtggaaaatatccgatctacccatgtaaagaattcaaggaaattgattttggagtagttgaaggtgaagatggtagtcagttatttaaaggaatgaaacatgataattttgtatcattactgttaaatgaaggatggagttctttagaaggagaaagcggttttgattttacgaaacgaattttcacaaaactagatgagataactgctcaatatcctgacgagaatatattaattgcgactcacgggggcacgattttaaatacagtagttaacattgaccataattttgttaatatggatggtccagctaattgctcgatcaccattattgatcgtcatggtgaatatcgagtgattgaatataacttacaggttgctcagtagattaaaaatagcatgattaaatgaagaaaaattaattaaaataaatgaaaaaaagccttgcaataggggcttttttttgttaaaatactaccgttgacgttgcaaagatgtgcgaggttgctgaaacaccgaaaggcgttgtcatgaaacggcatgtttcagggaattcgtattgagtaagtcacatcctataagttgaaaggagaaaaatcatggcaaataacaaaattagaattagattaaaatcatttgatcacaaaattctagataactcagcagaaaaaattattggtgctgctaagaaatctggagctcaagtagtaggtcctgtacctctaccaactgaaaaagaaatttatacagtattaagagcggttcacaagtataaagattctcgtgaacaatttgaaatcagaactcacaaacgtttaatcgacattgtgaatcctacacaagaaacagttgacattctaacaagattagaattaccaagtggtgtagacatcgaaattaaattataagaaaggtaaaaggtgtaactcatgaaaggaatcttaggtcgtaagattggaatgactcaagtcttcacaactgatggtttattaatcccagtaactgtagtagaagctgatgctaacgttgtattacaaaagaaaacagttgctactgatggatatgatgcaatccaagttggattcgaagataagagagaaaaattagctaataaagctgaattaggtattgtgaaaaaagctaacacagctcctaagcgcttcattaaagaatttcgttatgacgaaatgatgagttatgaagttggagataaaattactgttgatagcttcgtagcaggtgaagttgtagatgtaactggaacttctaaaggtaaaggttatcaaggtgttattaaaagacatggtcaaagaatcggtcctaaaggacatggttcaggagctcatagaattgttggttcaatgggaccaatcgctccaaacagaattgctccaggtaaaaaattaccaggacaaatgggacatgtaacaagaacagtacaaaacttagaagtggtagctgttgatgtagaaaataatttattattaatcaaagggtcagtacctggacctaaaaaaggattagtaattgtaaaatctggaattaaagcagctggtaaagtaaacgaagctcatgaattagtagactttacaccagtagtagaagaaactaaagaagcagatgcagcaactgaaacaccagttgaagcagctgaataatttagggaaggaggattcgatatgcttacagttaaagtatataaccaagaaggttctgaagtaaaagatttagaattaaatgaagctgtatttgggattgaaccaaataaacaagcattatttgatatggtcttattacaaagagcatcattaagacaaggtactcataaagtaaaaaaccgtactgaagttcgtggtggtggtaaaaaaccatggcgtcaaaaaggtactggtagagctagacaaggatcaatccgtgcaccacaatggcgtggaggaggagttgtatttggtccaacacctagaagttataaatttaaattaaatcgtaaagttagaagattagcgcttaaatcagcactatctactaaaattaacgataatgaattcatggctttagaagctattaaattcgacgctccaaaaacaaaagaaatggtgaaagtattagcaaatttagaagcaccagttaagacattgatcgttgttgacgaaatttgtccaaacgttgctagaagtgctaacaacatcccaggcgttaaattattagatgcaaaacatgtaaatgtttatgatatcttaaacagcaacaagttaatcatgactgaagctgctattaaatctgttgaggaggtactaggataatggcacacattacagatgtattaaaaaaaccagtacttactgaaaaaacaatgactcttcaagcaaacgaaaacaaatacacgtttgatgtagatgttaatgcaaataaagttgaaatcaaacaagctgttgaagcaatgtttggtgtgaaagttgaaagtgttaatgttatgaacgttaaacctaaaactaagagaatgggtagatacgaaggtaaaactaatcgtagaagaaaagctatcgttaaattagctgaaggtaacgaaatcaattatttcggtgaggaataattaactaaaatattggaatacataattccagataactaggaggaaactaaagatggcaattaaaacttataagccagtgacgaatggtcgtcgtaatatgacttcattaacttatgaagaaattacaacaaacaaacctgagaaatctttagttgcaaaagtaagcaaaaacggtggacgtaataaccaaggtgttattacaacacgtcatcatggtggaggacataaacgtaaatatcgtattattgacttcaaacgtaataaagatgatatcgttggaactgtagcaactatcgaatatgatccaaatagatcagcaaacatcgcattaattaactatgcagatggtgaaaaaagatatattttagctccaaaaggattagaagttggaagtaagatcgtatctggtgaaaacgcagatattaaagtaggaaatgctttaccaatgggaaatatgcctgaaggtactgtaatccacaatatcgaaatgcaacctggtaaaggtggacaaatcgcacgttctgctggtgtgtctgctcagatcttaggtaaagaagaaagatatgtaatcgtaagattagcatctggtgaagtacgtaaattattagctgtatgtagagctactgttggggttgttggaaacgaagaccacggattagttaactatggtaaagctggacgtatgagatggaaaggtgttaaacctacagtacgtggttctgtaatgaaccctaacgatcaccctcatggtggtggtgaaggtagaacttctatcggacgtaaagctccaatgacaccttggggtaaaaaagcaatgggtgttaaaactagaaaaaataagaaagcgtctactaaattaattgtacgtcgcagaaattctaaataataagaggaggaagaaataatggcacgtagtttaaaaaagggaccatttgttgatggacacttaatgaaaaaagttgaagcattaaacgctgctggtaaaaaagaagttatcaaaacttggtctagacgttcaacaatcttccctcaatttattgagcatacatttgcagtgtataacggaagagaacatatcccagtttatgtaactgaagatatggtcggtcataaattaggagaattcgctccaacaagaacttatcacggtcacggggctgatgataaaaaagctggaaaatagagagaggagattttaaaacatggaagcaagagcacaagctaaaatgattcgtgtttcacctcaaaaagctcgattagtcgttgacttagtgagagggaagcaagtaaaagaagcacttggtatgttagaatacgtaaataaaagtgcaactcctgcaatcattaaagttgtaaaatctgctgcacaaaacgctgtttataacgaaggtgcagaagcagaaaagttatatattaaagaaatctatgtagacgaaggtcctacattaaaaagattcgctgcaagagctaaaggtagcggaacaagaattttaaaaagaactagccacatcacttgtgtggtagaagaaagataggaggtcacattatgggtcaaaaagtaagtccaatcggattacgagttggtgttaaccgtaattgggattcaagatggtatgctaacgatcaagatttcgcaggtttattacatgaagatatcaagattcgtgaatacctattaaaaaaacttaagactgcatctgtagctaaagttgaaatcgaaagatcaaaaaatcgtgttactatctttgttcacacatctagaccaggagttgtaatcggtaaagatggtgaagcagttgatgcattaagaaaagaagttagtaaaatggtaaaagataaacaagtgtttatcaatattgtggaaatcaaaaaccctgatgttgtagcacaattagttgctaataatattgcggaacaattagaaaatcgtgcttcttttagaacagttcaaaaacgtgctatccaaagagcaatgagagctggagctaaaggaattaaaacaagtgtttcaggacgtttaggtggagctgatatggctcgtgctgaaggttactctgaagggaatgtccctcttcatactttaagagctgatattgattatgctactgcagaagcagatactacttatggtaaattaggagttaaagtttggatttgtaagggagaaatccttcctgaaaagaagaaaggggataaataatcatgttgatgcctaaaagaacaaaatacagaagacctcatcgtgttaaatatgaaggtaaagctaaaggcggaactgaagtatcatttggtgaatatggtttacaagcaactgaaggtgcttggatcacttctcgtcaaatcgaagctgctcgtattgctatcaaccgtcgtttaaaccgtggtggacaagtatggattagaattttccctcacttagctaaaactaaaaaaccattagaagtacgtatgggatctgggaaaggttctccagaagaatgggtagcagttgttaaaactggtcgtgttcttttcgaagttgcaggtgttgatgaagaacttgctagagaagctttaagacttgcatctcataaattacctattaaatgtaaaatcattggaaagggtgaatagtcatgacagttcaagaaatcaaagaattagataacgctgctttacttgctaaagtagaagaatacaaaaaagagctatttggacttcgtttccaacaagctacaggaagtttagaaaacacagcacgtattagaacggttcgtaaatctatcgctagaattaaaacaattattagagaaagagaattgaaccaataggaggagatacaatggaaagaaacaatcgtaaagtttatactggtacagttgtatctactaaaatggataaaactattacagtgcaagtagaaacacatgtaaaacataaattatatggtaaacgtatgaaatcaacaactaagtttcatgcccatgatgaagaaaatatcgctagtgttggcgatacagtaaaaatcatgtcaacaagaccattatctgcaacaaaacgtttccgtttagtagaaatcgttaaaaaagcagaaactgtttaatatatattaaaactctaaaaggaggtaaccaagaatgatccaaaacgaaagtagacttaaagtcgctgacaacactggagctaaagaagtattagtaatccgtaatttaggtggttctaatcgtaaatttagtaacatcggtgatgttgttgtagcaacagttaaacaggcagcaccaggtggttcagtaaaaaaaggtgaagtagtaagagcggttatcgtaagaagtagatatggagtcggaagagaaaacggttcttatattaaatttgatgacaacgcttgtgtaattataaaagaagataaatctccaaaagggactcgtatcttcggaccagttgcaagagagttaagagatgctgatttcatgaaaatcgtatcattagctccagaagtattataggaggaacttaaaacatgaaaatccgtgtaggtgatactgtagaagttatcgcaggtaaagataaaggaaaacaaggtgaagtgttacaagttcttgcaaaacaagacaaagtaatcgttgaaggagttaatactgtaactaaacatattaaaccttcacaagcagatcctgaaggtggaattgtaacaagagaagctcctattcatgtttctaatgttgcattctatgattcaaaagctaaagctcctgttaaacttggatataaaatcgttgaaaaagacggtaagaaaacaaaagttcgagttaacaaaaaaaccggagcagaagtagataaaaagaaaaagaaataatggaggaggataaagaatgaaccgtttaatggaacgttatcaaaacgacgtagtaaaatcattggtagaaaaattcaattattcttctagcatgcaagctccaaaggttgaaaaaatcgttttaaatatcggtgttggtgatgcagtttctaactctaaattattagatgaagctgttaatgaattaacattaattactggacaaaaaccagttatcactagagctaaaaaatcaatcgctggatttaaattacgtgaaggtgctccaatcggatgtaaggtaactttacgtggtgaaagaatgtatgaatttttagataaattagtaaatatctcattgccacgtgtaagagattttagaggtgtatcaaataactcatttgatggaagaggaaattacactttaggtattaaagaacaattaattttcccagaaatcaattttgataaagtaaacaaattaagaggaatggatatcgtattcgtaactacagctaagagcgatgaagaaggtcgcgagttattagctcaattaggaatgccgttcaagaaataaggaggactcacaaaaatatggcaaaaacatcaatgaaagtgaaacaacaacgtcctcaaaaatacaaagtgcgtgaatacacacgttgtgaacgttgtggaagaccacattcagtaattagaaaattcaaactttgtagaatttgcttccgcgaattagcttacaaaggtgaaattccaggtgtaaagaaagcaagctggtaattagattttatccagatggaaggaggattagcaaatggttatgacagatccaattgcagatatgttaacaagaatccgtaatgcaaatagacaacatcacgaaacagtaatggtgcctgcatcaaaattaaaagctgatattgctgaaattttgaaaaacgaaggattcattaaaggatataaagttgagggcgaaggtccaatcaaaaacattaatatcactttaaaatatagaggaaatgatagagtaatcactgatttaaaaagaatttctaaaccaggattacgtgtatatgctaaagtaaacgaaattcctaaagtattaaatggtttaggtatcgtaatcttatcaacttctcaaggtttgatgacagataaagaagctcgcgctaaacaagttggtggcgaagttcttgcatatatttggtaataaaaaatacaattcaggaggtgcaaactgatgtctcgtgtcggtaataaaattattaatgtacctgaaggagttacagttgatatcgctgctgataatacagtaactgttacaggagctaaagggactttagtaagacaattttcaccagtaattacaattaacaaagaagataatgtaatcactgttgctagaagtagtgaacaaaaaactcataaacaattacatggtacaacaagagcattgcttgcaaacatgattgaaggagttcatgaaggattcaaaaaacaattagaaatagttgggattggatatcgtggacaaatgaaagggaatactttagtgttaaacattggatattctcatcaagtagagattgaagctgaagaaggagttacaattgaaactcctaacaatacaacaatcgttgtatctggaatctcaaaagaacgtgttggtcaagttgctgctcaaattagagaagtaagaaaaccagaaccttataaaggtaaagggattaaatatagtgatgaaagaatcatcagaaaagaaggaaaaactgctggtaagaagtagtttcgaaaggagcaaaataagatgtcaaaattacaatctcgtaatgatgttcgtttaaaaagacatgctagagttcgtgctaaaatcagtggaactcctgaatgcccacgtttaaacgtgttccgttcaaatgctcatattcatgcgcaagttattgatgatgttaacggtgttactttagcaagtgcatctagtgttgatatgaaattagaaaacggttctaacatcgctgctgcaactgcagtaggtaaagctgttggagaagcggcaatcgcaaagaatatcaaaaaagtagtatttgatcgtggtggatacgtttatcatggtcgtgtaaaagccctagctgaagctgctagagaagctggattagaattctagaaggaggtcaatatggaacaacgtaaaccaagaaacaatggaccaagaaacaacggacctagaagaggtcaaagaaacaatggacctagaagagaagaaaaagaatttgaagaacgtgttgttactattaaccgtgtaactaaagtagtaaaaggtgggcgtaaattccgctttgctgcattagttgtaatcggagatagaaaaggtagagttggtttcggtactggtaaagcaaacgaagtacctgatgcaatcagaaaagcttctgaaaatgcaaaaagaaatgttatcaacgttccttcagttcatggaactattcctcatgaagttactggtatttatggatcaggtagagtatttattaaacctgcttctcaaggtactggaatcatcgctgggggaccagttcgtgctgttgtagaattagctggttatagtgatattttatctaaatctttaggttctagaacacctattaacatggttagagctacaatggaaggtttagcttcattaaaaactgtaaaccaagttgctgaattaagagataaaaaagtagaagaaatttttggataggagggcgtaaaaaatggcaaaaacagttatgattacgcttaaaaaaagtccaattggttgtttaccaaaacaacgggctactcttaaagcgttaggtttaacaaaagtaaataaaaccgtagaaaaagaaaacaacgaattcattcaaggaatgatcaaagttgttggacacctaattaaagtagaagaaaaatagggaggtgtaaactaatgaaactacacgaattacaatacactgaaggtgctcgtaaaacaagaaaacgtgttggacgtggtacaagttctggtactggtaaaactgctggtagaggacaaaaagggcaaggcgctagatctggtggtggaaagaaacctggattcgaagggggacaaactccattattcatgcgtttaccaaaacgtggatttacaaactttaataaattagaatacgctattgttaatttagatcagttaaatacttttgaagcagggactgttgtatgtcctaaagcattaaaagaagctgggttaatcaaaaaagaattagatggtgttaaagtattaggtaatggaactttagaaaaagctattactgtaaaagctcataagttttctaaatctgctcttgccgcaatcgaagctgcaggtggaaaaaccgaggtgatctaagatgtttacatttttgaaaaatgttttcaaaaaaggtgaacttcgtcaaaaagtaattttcactctggggattctatttgtttatcgtctgggagctgcaattactattccgagtgtcaacactggagcattaagttctagtgatgccactaatgggatttttgggattatgaacttactaggtgggggaacattagagagattctctctattctcgctaggagtttcaccttacatcacttcttcaatcattattgaattattgtcaatggatgttattccggcattgagccaatggcgtaaagaaggtaataccggtaaaaagaaaaaagaccgggttacaagatatgtaacattattcttagcagcattacaaggtggcgtattaacttacgctttcgataatggatacaagattcttgcagattctagtatctggacatatatctatgttgtcttaattatgatggcaggtagtatgttagcagtatggttaggggatcaaattacaaataaagggattggtaatggggtatcattattaatcttcactgggattgtttcaaacttaccgagcagttttatttcaactttcaacaacttagttgatacttctggtaaagctggggatatgtggcttggaattgcctggtatgcattatttgtggtagtttatctttcaatcgtgatctttgttgttttcaatgaaggtgccgttagaaaaataccaataatttatgcaacaagctctaatacaacaatgagaactaaagatcaaactcatatgcctattaaaattaatagttcaggggttattccagttatctttgcttcatcagtattagcagcaccaagaacagtagttagttttatggaaactagcgatgttactaaatggatcaatacaatctttaattatcaagaaccagttggattcgtcttatatatcttgatgattattggatttacattcttttattctaacttacaaattgatgctgaaaaaatcagtgatgatttaaagaaaaacggtggagcaattccgggagttagaactggagttgatacaatgaaacacattaagacaattttaaacagagtaactgtggtaggatcattatcgttatgtatcattgcagcaattccaattattacaccagttatctggtcacaaacagcaaacgcatctttatcacttggtggtacaggtttaatcatcgttactggggttgcactagaaactgtaaaacaaattaaaactcatattacaagaaaagaatatcacggttatattcgtcgatagtataagaaagaaggggcaattatatgaacattattctaatggggccacctggagcgggaaaaggtactcaagcagctaatttagtgaaagagtatggacttactcacatttcaacaggagacatttttagaaaagcacttaaggagcaaactaaatatggagttattgcaaaatacttcatgcaatttggtcacttagttcctgatgattatactattcaaatggttagagaatatcttcaagaaaatgaatttccaaatggatttattcttgatggtttccctcgtactattattcaagctcgtgagttagaaagtattgctaaagaatttggatttgaaattgatgccgtaatcaatttagatatcgaattagatcgtttagtaccaagactttctggaagaagaacttgtaaagaatgtggtgcaagttaccacatcgaatataatccacctaaagttgaaggggtatgtgatgtttgtggtggtgagttgtatcaacggcctgatgaaagcgaagatgctgtaaaagtcagactggatacttatgaaaaacaaacaagtcctttaattgattattatacaatgaaaggacaaatcactaatataaatggtgatcaatctatggaagacgtctttaaggatatcaaagctagcctggaggttaaataatgattgttactaaagaccgtagagaaattgaattgatggctgaagctggaagaattgttgcattagtgcatgaaaagcttaaagaagttattgtcccaggaattacgacaaaacaaattgatgagatttgcgaaaaagtgattcgtgataataatgcaactccttcatttcttcacttatatggatttccaaacagtgtttgtacttcaattaatgaagtagtcgtacatggaattcctagtgatcgaaaattagaagaaggtgacatcatttcagttgatgttggggcttgttataaaggatatcacggagatagcgcgtggacttatgcagtcggtaaaatcagcgatgaagctaaacggctgatggaagtttgtgaagcttcattatacgctggattagaacaggttaaacctggtaatcgcttatcagatatttctcacgctgtgcaagtataccttgaagatcatggatgtactacaccgttagattatacagggcatgggattggtactgaggtacatgaagatcctgctgttcctaattatggtcaagctggtcgtggtccaagacttaaagcaggtatgacacttgcaatcgaaccgatggcacatctaggtggatgtgaaacggaagtattacaagatgattggacagttgtaacaaaagaccgctctttagcggctcattatgaacatacgatcgtcattactgatgacgggtatgaaatcttaacaaaactttaatttaagggagttgaaaacctatggcaaagaaagatgacgttcttgaagtagaagcaacggtacttgaaacattaccaaatgcaatgtttaaagtagcgttagaaaatggagtagaaatccttgctcacgtttctggtaaaatccgtatgcattacattcgcattttaccgggggacagggttacggtagaaatttctccatacgatttaacacgtgggcgaattacatttagacataaataaaacttaaatcttccaaaaggaggtagacaagatgaaagtaagaccatctgtaaaaccaatgtgtgataaatgcagagtaattaaaagaaaagggcgcgtaatggttatttgcgaaaaccctaaacataaacaaagacaaggttaattagtagttaattaggaggaaataaaatggctcgtattgctggagttgatatcccacgtgacaaacgtgtggttatctcattaacttatatctatggtatcggtaaaccaacagctcaagaaattttgaaaaaagttggaattaacgagaacactagagttaaagatttaactgaagatgaaatcggtacaattagaaaagaaatagaatcaattaaagttgaaggtgaccttcgtcgagaagtagctttaaacattaaacgcttaatggaaattggaagctacagaggaatccgtcatcgtaaaggacttcctgttcgtggtcaaaagactaaaacaaatgctcgtactcgtaagggtaaggcaaaaccaatcgcaggaaagaaaaaatagataggaggttgaactagaaatggcaaaagttaaacaagtacgtggtaaaaaacgtgcaaaaaagaatatcgcaaaaggtgtagcacatgttcattcaactttcaataatactattgtaacaattactgatgaacatggtaatgtattaacatggtctagtgctggtgcattaggatttaaaggttcaagaaaatctactccatttgctgcgcaaatggcttctgaagctgctgcaaaagcatcaatggatcacggagtaaaatctgtagaagtatgtgttaaaggtcctggaccaggacgtgaagcagctgttagagctttacaagctgctggattagaagtaactgcaatcaatgatgttactccaattccacataacgggtgccgtccaccaaaacgtcctcgtggataattattgtatgatcaaaaaaaataataattcctagtgaggagggaaatagatgcaaaagtttgaaaaagcaaattttaatatagctaattatgatgaaacagataattatggtaaatttgttattgaacctttagaaagaggtttcggtacaactttggggaattcacttcgtcgagttcttctatcttctttacctggatctgctgtatatgcaattaaagttcaaggtgctatccatgaattttctgcagtagatggtgttgtcgaagatgttacatcaattatcttaaatcttaagaaattagtctttgatgtggatagtgatgaatcggctacaatgattattgatgttgaaggacctgctactgtaacaggtgctgacattcaatgcccttcagaagtaacaatgatttctaatgatatggaaattgctcatgttgctcaaggtgctcacttatacatggaattatatgctaaaaaagatcgtggttatgtaagtgctgatcaaaataagaaggaaattaatactattggtattattcctactgattcaatttattcaccagttgaaaaagtatcttatgcagttgaaccaactcgtgttggggaaagtgccaaatatgatcaattaactttagaaatcgaaacaaatggagctttaaaaccttatgaagctatttcattagctgctaagattttagtagaacatttaaatatgtttgtagagttaactgatatggctgtgaatatggaagttatgtctgaagctcaaagtgatacaactaataaagtattagatatgacgattgaagaattagatttatcagtacgttcatacaactgtttaaaaagagcaggtatccaaactgttcaagatcttgccgctaaatctgaagatgatatgatcaaagtaagaaacttaggtaagaaatcgttaaaagaagtaaaagaaaaattagttgaattagggttagggtttaaacctatcgattaattcgcgagtacgaaggaaggagcgctaatctcatggctaaaaatagaaaattaggacgtacttctgatattagaaaatcaatgttacgttctcttgcaacagaagtaattatgtacggtaaattagaaactacagaaactagagctaaagaagttcgttctgttgttgaagaattaattactttaggtaaacgcggtgacttacacgctagacgtcaagctgctgctgtattacacaatgtagttgatgctgaaactggaaaaactgcagtacaaaaattatttgatgatgttgcacctaaatatagtgatgtaaatggtggatacactcgtatcttaaagacttacaaccgtaaaggtgacaatgccccaatggcaatcatcgctttagtttaattgttaaagaccctcgggtcttttttcttttactttgcttgactaagtcaagtaataataatagaatgtttaggagtagttaaacgggtggtgaaaaagatggataaaatcattgaaataaaagatttatcatttgaatatgaagctggtctaaagacgatcaatcatatttcttttgatataaataaaggagattatgttgctattttaggacataatggtagcggaaaaagtacgattgcaaagttactaattggactactagaaaaaaagagcggttcaattattattaatggatacgaacttaatttggaaaatttatataaagtcagagataatataggaattgtttttcaaaatcctgataatcagttcattggggcaacagttcgtgatgatatagcctttggtttagagaacacatgtgtaccacaaagtgatatggataaaatcattaatacttatgcagctaaagtaggtatgagtgattttcttgatcatgagccaactaaattgtctggggggcaaaagcagcgagtggcaattgctggtattttagcaatggctccaacaatcattattttggatgaagcaacaagcatgttagatccaatgggacggcgtgaaattaatagtctagttaaggaattaaataaagaaaaagatattacgattatttctataactcacgatattgaagaagctaaaaatgctgatcaggtaattatgttgagtgctggtgaagttgttgcaagtggtaatcctaaggatatcctaagtgatgaagccaatttggtcaaatatgaattagatatcccatttgctttaaaagtagctaagggtttagaaaaattaaacattaggactagcatgtctttacaagaggaggtattaattacagaattatgtcaattacatttaaagaagtagaacatatttatagtgaaaataccccttttgcttaccatgctttaaaaggagtaaatttaaaaattactgatcaaagctttacagcgattattgggcagaccggtagcggaaagagtactttgattcaacatatcaatgctttgttactacctacaagcgggagtatcaatattgatgaatatctaattacagcaaccgacaaaccaagtaaattaaaaccacttcgtaaaaaagcaggactagtttttcagtttcctgaatatcaattatttgaagaaacaatcgaaaaggatattatttttggacctatgaattttggagtcagtgaagaagaggctaaaaaaattgctcataacgttctcaaaacggtaggattagacgaaagctatttaaataaatcgccttttgatttgtcaggtggtcaaaaacgccgagtagcaattgctggaattttggcaatgaatccggatattttaattttggacgaaccaactgctggattagatccgcaagggactaatgaaatgatgagtttatttaaacgaataaatgaaagtggtaaaactattattttagtaactcatgatatgaatcatgttttacaatattgtgatgaagtagtagtaatgaatcacgggaaagttgaaaaacatgatacagtcactaatgtttttaaggatagtgagtatttaaatagcttggggatcgatttaccaatcattactaattttatcataaaactaaataatcaaggatttaatcttgattcttcaattaataatattgaacagctcattgcagcgattggcggtgaattaaatggataatatgacatttggtaaatatattcctgttaattctttaatccatcaattagatccccgattaaaaataggagctctactaatctttttaattgctattttctttgatgcagggtttattggatatggtatcatgggagtatttgttttgttagttgcaggattatcaaatatttctattaaacatattttaaaagcaattaaaccgatggtttttatgatgctcttcttaatgatttttaatatttttttaatcaatacaggaagtgtattattcacaattggatcacttaagatttattcgggggcattgattcaatcagcgtatatttttattcgcttaattttaattattactttgacaactatcttaacatcttcaactaaaccgctcgatttaacactagcaattgaaaatctattgaatccgtttaagcgttttggtttccctgctcatgaattggcgatgatgatatcaattgctttacgttttattccagatttattagatgaagctaagcgtatcatgaaagctcaagcaagccgcggtgttgactttaatgaaggtactatttcggaaaaaattaaagcgattgtttctctaattattcccttatttatctctgcttttcaacgagctgaggatcttgccaatgcaatggaaagtcgtaattataatcctgaagcatcgcgtactcgttataaatcattaaactggcagaccagtgatacaatggcctttgcacttacaatagttgtttccggtactgtgattataatgagctttgttttgtaatggttagggttaaatgtagtgtaagctatgacggaagtaaatttcatggctttcaagtgcaaaataaattacgaacagtacagggcgagatccaaaaggcattaaaaaatatatgcaaagaagagattattattcatggttcaggaagaaccgatgcaaaggttcatggaactaaacaagtttttcattttgatactacaagagaaatgcctgaagcgcagtggaaacgggcaattaatcattttttaccaaatgatatatatatcttagattcatactttgttgatgagaattttcatagtcgttatagtgcaataaaaaaagaatatcattatttattaagtacaaatgaatatagtccatttgaaacgaattatatttttcaatatggacgaccattagatttagaattgatgagagaagcagctaaaatatttattggtgagcatgattttgcatcattttgtagctatgatcagtatggtaatacaattagagaactatatgagttgtcgattactaatgaaaaggggattattaaatttattttagttggaaatggatttagacgttatatggttcggcatatcgttggtggcctaattcaagttggggcaaaacgggttactaaagaacgattacaagagttattagatagcaaaggtgaacagaagtgtttgtttaaggctaagccccagggactatacttacatgaggtgttttatgatgaaaactaattttcatacacatacattccgctgcggtcatgcggttggcaatgaagaagcaatggttaaatcagcaattgaagaaggtattgaagttttaggctttagtgagcatgttcctttaccacgttatcgtaaacatatctttaaaggaatgcgttatactcttaatcattttcgttcgtttgcggttgcttgtaaagcaatcattactaatggtcctgcaatgcgaatgccatataaagataagcagttacatcttgaagaagtaaagcggttaaaggaaaaatattgtgatcaaattacaatatatcaaggttttgaagctgagtattttgaagaatatttagattattatcaaggattattaaattcaggagaagcagattatttgattttaggaaatcactttaataagtacactgttcatactcgttattatggtaagatggatattagtgatgaagaaataattagttataaaaacgatttgttgaaggcattagatactaatttattttcttatgtagctcatcctgacttatttatggttggaaaagtatatttcgacgagttatgtgaaaatattacccgggaaatatgtcaaaaagcattagaaaaagacgttcctttagaagttaatgctggtgggattcgccgtggctatcgtaaagtcggggacgaaatccaatatccatatcccaatagtcacttttttgatattgttggagaggtagggtgtaaagtgattcttggaattgatgcgcatagtcctgatgatttcaatcaggatgattttgaagctttggagaagtttgcatggcgtcacaaattaaatgtaattaatatacctgaatttaaaaaaggtaaataaggatggaatctaagagcgttgggttccatcttttattacgaataattaataaaggagcgacaatattttagggtattatagctaatgatttacaagcataaataagatattatatgctgttgtttaagtatataatggtagtattgaaatttttttgtaagatcaaaagaagatcaagaagttttaatctggataaagattattgaagtgaatcatacttttttatggtcaatcaactgatggagtgggagaactagttactgcagttaagacaggtgaggatattgattatcaaaattatcttttattaacaatacttggtttacaagatgtatcggttattatgaaaaaacatagctaatatttaataagtacttaattgtaataattgggtacttattttttcgtattggtttaattattggtacataagtggtaaaatgttacataggaactaggaggtgaagtcatggcacgtgagtgtatacacaaatatttagaagagcataagagtaattatcaaggtaagtaccgctgtcatagttgtgttcaaacaaaaaaatttgaacataagttccattattatattcgtgatacgcaatttagagaaatcaatgtctttgtaactttagattatgcgggaccagaagtgaagacagtattttcagttgatcttcatgaacaggaagaggaatatattactaaggatgctttaaagcaaataatttatttcaataaatatcgaacaattttacattgtcatgtttttcaacattatataaatagtaaaaatacagagaatatgttagaaccattagattatcgtaatattttagattatttagaatatcatcgtggaactaatcaagagacaattgatgagttttatgatttctttatgccttatttaaaaaggttgatacgaaatggtaattataaacgatttatggattcattgaatcttttattagataaaattatttatgagtatgaatgggatggtacgacggctaaatatttagatacccaatatcaatatcatttatattattttagaatcattattaggatggtttttgatgacttggatattttctatgatcaagttaaggaaccattattagaagcaatttggcgtttatgtaattcacagcgttttgcttttgcaatcatgacagattttggtaatttggttttatcccattatcgggttactaaagcaatctttaattatgttgatgctcgttttcaaaaagagggtgacagtaacatcgtcattccatatttaaaagcaatttttgaaagtgatgctgatggttatcgtaatgctgctatggatgttattcgttttgtgatgaatgatatgctgacttttgcaaatcatgatttacaattagctatcggaaattcaatcgtacaaaacgaaggatatgatttattgattaatttattttcaaaagattataatacatttgtttttgtttgcttcccgatttctactttcccaccagagtatcgtgaaccaattcgtgaagagttagaaaaagccattcgtttctatgcaggaagaatggaacatgacgagtaccgtctaagctcttttgaacaagttagtaacatcaatcgattattaatggaaaattataaggagtatggtaaaaatggataaaaaaggaaaaaaagtagttacctcattagcagttttagctgggttagcatccggggctggagctttaaatgcctttgctaataaaaccgttaaagcaatgttataccgccatcataaagaagatgataaaccaagtattttagaaacaaaatatgatgcgcaaagcatttatataaaaaatcaccaaggtattagattaagaggtgtccttattgaagcagttgatgcgaaaaaaactttagtaatcttgcatccatttgctctggaggctaaagatatgactttatatgtaccgttttttaaagaacgataccctgattggaatatcttattagttgatgcttgtgcccatggtcaaagtgatggatatatccgtggactaggtattaaagatgtaaaagatcttgtttgctggaacgaatatttgttaaaaacatacggaaaagagcatgaaataattttatatggtaaagaagctggtgctaatactattttaaaagcagctagtaaacatttattaaaaaatgttaaagctattattagtgatggagcctatacaagtgtgtatgatattttaggctatcgaatgattaaggattataaagtaccaaaatttccaacaatgcgtttaattaagcgtaagattaaacaggaaattaaagttaatattaaagaagattatgctgaaatggtcaaacataatgatattccaacattatatatccacatgaaagaagatgattttgtaccattaagtatggtctatccattatataatgcgaaccgtggtagcaaagtattatttgttttaaaagatgaacgttatttatatgaattagaagaaaccgatgaatttagaaagacattagcgaatttcattactaagtatgtaaattaggctggtggtatttgtggacaataaattaaaaattggcttgctggtagatgatagcgataatatctttactactgaaatttggcggggagcgagttatgcagccggaaaattggatgttaatttagttgtattttttggtggatttgtaggaagctcaaacatctacgggaattcaaggtatgagtttcaaaaaaatacaacttataaattttccaagacaaaagatttagatttattaattataagtgtctcaagtatcgttcatgggaataatcgtttaaaagaattattcgtaaaagaatttgaaggtgtgccaattgttactttaaaccataaatttggaaataattcactagtaacatttgataatgctaaagggatagaggatgcagtaactagtttaattcaagaacagcaatgtcgtaaaattgggatgattgctggtccttatgaaaataaagggtcggatgagcgattagctgcatataaaaaaacattaaaaagtcacggaatcgtcattgacgaaaaaagaattattcatacagcaacatttgaacgtggttatcctgaatatgccaagaaattattggatttgaatcctgatttggatgctattgtttgtgcaagtgataatcttgcctttgatgcgtatcaagttttaaaagaacgagggattcgaattggtgaagatgttcaagtagttggttttgatgatgttcaagaagcatcaaaagtaaacccgcctctagcaactatccgtgccgaagcagcacagttaggattttatgctgtcatggatggggttttatcattgcgaggagaaattccagctgaattcacaacacttgtcgatatagattttattaaacgagattcggctgctaaagtgggttatttagaagaacgattatatcgtcaaatagttaattatacaaagagcgacaaagataaaatcgttaatattttaatggagtatatttttaataataaccacagtatttttattattgaagcccgcaaacgcgtaattgatttagttacttttctagttgaacttcataatgatgacttattcgaagaaaaaacatatacaaaattttcaaatttaattcaagaattaatagatttagatagtgttgagtttattgatttaaaaagaattttaaaagttattgatgtggttagtcagcgtcttagtgattatcgtaataatctatcaattattcatttcaatcaaaaaatcctacaaattattggcatgcattataatactattttaagtgaaagaacaaggatttcttgtgaagagaaacggctggttaatattttatcaagaggaatgctcagtgttcgaaacgagtatgataactacaatactatttttgaatgtttaaagcagctgaatattggtaatgcaagattatatttgtatgaaaaaccaattactagttatatgacacaatttacagttttacccaatgaggttattttgaaaggaagtataattaatggtaagattattattcctgatgataaaattctggttaaaaccgatcgaatattttcagaaaagagattgtttagtaattgtaatgaatatgttgttaactcagtttattctggaacaacacagtatggaatatttgtttgtgatttgaaatatcgtgattttgtagatttagattttgtttctagtcaattaggaacagttgtaaatacgatcaatttagttgagaagttagataatttatcaaaacatgatgagctgacggggctatggaatcgccgaggttttattgataaagtacaaggatatatgaatattaataaaggtgcattgatttttgtggatcttgatggtttaaaaattatcaatgatacttatggtcatgaaggtggtgatgaagcaattatcacgggagctaagattcttaaagatgcttttgatgaatttggtgtaattgggcgtattggcggtgatgaatttgcagtatttttaccaaatcaaagtgattttgctctttcagaaattgatcaattaataaatgataaaacaatctatcataacactttaataaaacgtaattttaaagtagaattatcttatggaattagtctttttgatcaatatcaagatttaacagttcgtgaactcttagataaagcagatcgggagatgtattgccataagcgtaataaaaaaggaaataggaggaaaaaagatgtattttaaagacagtaaaggctttccaagtgactttctttggggcagtgcgtcggcagcctatcaagtagaaggagcttgggatagtgatggtaagggagtttccaactgggataaatttgtacgtatccctgggaaaactttcaaaggaacaacaggtgataaagctgtagaccattataatcgttataaagaagatgttgctttaatggcagaaatgggtctaaaaacttatcgtttttcaattgcctggacaagaatttatccaaatggaaacggtgaggttaatgaagctggtttacaattctatgataatttaattaatgaatgtttaaaatatggaattgagccaatggttacggtatatcactgggatatacctcaagctttagaggagcaatatcatggttgggaaaatcgtcaaattgttgatgattatgtaaactatgcaactactttatttaaacgatatggtgatcgtgttaaatactggatcaccatgaatgaacagaatatctttactagctttggctggttagaaggaatgcatcccccaggaaaagtagatgatatgaaaatgttctatcaagttaatcatcatgcaaatatggcacatgctaaaagtgtaattgcattaaaagaattatggccagaagcgaaagttggagcaagttttgcttatagtccatcttatgcaattgacaataaaccagaaaatgcaatggctaaagcagattatgatgatttgaagaattattattggatggatgtttatgcttatgggcgttatcctcgcgctgctcttgcttatttagaggctaatggtgttgcccctgtttttgaagaaggtgacaatgctatcatgaaagaagctgcacaattagttgatttcatgggagttaactactatcaaacaactacagttgaatttaatgatatcgatggtgttggaacaagtcatgaaatgaatacgactggtaaaaaaggtactgctaaagttcaaggtgtaccaggactttataaaaatcctcaaaatgctaatcttccaacaactgattgggattggacaattgatccaatgggaattagaatgtgttgtcgtgaaattacatcacgctatgatttaccaattgttattagtgaaaatggtttaggagcttttgataagttagaagatggggaagtacatgacccatatcgaattgcttatttaaaagcacatattgaggaattgaagaaggcttgtgatgatggatgccgtgttcttgcttattgtacatggtcatatacagatttattaagctggttaaatggatatcaaaagcgttatggttttgtttacgttgatcgtgaagaagatgaaaatagcggtactttaaatcgttataagaaagattcatactattggtataaaaaagtaattgaaactaatggtgaagaattataaggaaacagggttaatcctgtttttctttttcaataaattgtgtataatgagtgagagagaagagggatgaacatgagacgtaaagaaaatactgaagttgatatcttgtataatttattgacatatattaatgcttcatacagccaagatatgtattatacgatctgttatcaagtattaaataatattgaaaagattccagatatctcaatcaatgagttagcggacttatgttatacttcgcctgcaaccatttcccgtttttgcaaagctttaaaatgtgataattttgctgaatttaaaaaggaagtacaagtaggattaaaacaggcaagtcatgagattaaactccatcctgatgatttagtagagattcatcaaaatcctgtacactgtgttgatatggtctatgatctaacaattaattcattaattgagagtaagaaacatattaatattcatgagattgatcgcctatgtgatattatttatgatgcgaaaaagttacatttttttggtttccaatttaataagattttagcctcagatattcaatttaaattagttaagctaggtaaattttcatacgcctttgctgatcgtggtgacgatagtcaaagaattgaacttttagatgaggatagtgtggctattgtactttcagttcgagcgcgattatcaccggttggggatttaatcaaatcaattaaaaatcgtgaagctaaagtaattttagttactttaaatgctgaaagtgaagtaattgaattagctgataaaacttttgttgttcatggtaaagaaagtgattttacagagtcatcaatttctggaacgacagtgatgaaaacgttttttgatgtattgtatgtaagatatggattattatatccaagaagataagggggcaggttatgtatagttttactaatgattatagtgaaggtgctcatccaaaaataatgaaagccttaattgaaacaaatgatgagcaatgtgctggttatggattagataaatattgtctagaggctacaagattgttaaaaagacaacttcaaaatgataatgttgatatacactatttagttggtggaacacaaactaatgcggtatttatttcatcagtattgcgtccatatcaggcagtgattgcagcagatagcgggcatattaacgttcatgaaaccggagcaattgaagctacgggacataaagttttaactagacctcaccaagatggtaaattaacagtagcgatgattgaaagtattatcgaagagcattcggatgaacatatggtgcaaccaaaaatggtatatatttcacaatcaacagaatatggttctgtttatagtcttgatgaattaaaggatatagctactttatgtaagaaaaaagaattgtatttatttgttgatggagctcgattaggtagtgctttggcgctacccgatacacctacatttaaagatttagcggattatagcgatgctttctatattggaggaacaaaaatgggagcattattcggtgaatgtctagtaattgttaatgatagtctgaaagcggattttagatataatatgaaacaaaagggggcgatgatggctaaaggtcgacttttaggagtccaatttaaagaactttttagtaatgatctatatttagaaattggaaaatatgaaaataagatggctgatattttacgagctggtctaaaagattttgaaatgatggtaccttcacaaactaatcaagtatttccgataatggatgatgagttgattgctaaattacaacaagattttagctttaatatcatggatcgcattgatgatcaccgccattgtatccgtcttgttacttcttgggcaacccctaaagaagctgttaattcgttcgttagtaaattaagcgaactactacataataacttgtaataaatattaataagtaatataatattcgtaggattattcctatactatatagaatggagaaattaaaatgaacaaaactgaattagtagaagcaattgcttcaagtacagaaatgacaaaaactgatgttgataaagtagtaactgcatttgtagacgtagttactgaagctctggtaaaaggagataaagtatctcttaaaggatttggtaactttgaagtacgtgaaagaggagaaagaactggacgtaacccaagaactggtgaaacaatgacaattgctgcaagcaaagctcctgcattcaaatctagtagtgcattaaaaaatgccgtaaataaataatataatataaaaatgaccttcgggtcatttttaattgggtatgaacgtcaaaatcatcttaaagtagcaggggtaagaactcatttgattgtctgtttagcggctgctatgataatgattgtttctaaatacggttttaatgatattttaagccacgaaggaatagcacctgacccatcacggagtgcagcacaaattatttctggagtaagttttttaggagctggtataatttttgtgcataaacgagaaataaccggttttacagcagcagaaatttgggcagctgcggcagtagaaatggcaattgtggcgggaatgtatgtgattggaatcttagccactattttaattttgttagttcaaattatttttcacaaacaatatcgttggattcccacagtatgggagagctggttaatttagggtaaaggataaatctgatgtaatttccaaaattcaaaaaattatgcatgagtatcatattgagataatgaattttaaagttagtcataatcaaagtaccataatactagaattattagtcaagttgccgaccagtttccccctagaagatatgttgactttatttgataaaaataatgatattatttcaatcgagataaaataaaaagcctattataatttaggctttttctataatgaaaatatataataataaagttaaatatgtgatattattaaatggtaatattggaggaaggtactaatatgtataaatatgaaaaggttgaacatgataatgagctgccgactaaattacatgatttttatatcgaagataatattggagaaccaattgaaaagcattggcatcgaagtattgaaattctgataccattatatggttcatttattttatggataaatggtaataaagttaaaataacagctggaaatatttatattattaattctcaagatattcatgcaattcaggctatcgagggtgagcgtatatataagggctacgccctacaaataaaatatgattatttgagggaatcgtatcatgatatagataaaatttattttcaacagcctaatcaacaaatcaataaattacttatggctaaaataattgatattattaatttttatgaaagtgacgatccgtataataacattcgagttaaaagtcatattcagatgcttgttttcttattattagataatcttagtaaaaaaagaatcgggtatctagaggttaaagatagtaaatataaagatcgaattacaaagattattaagtatttagaaaataattatcaagaagatctctcagttaaaatgattgctgatgaattcggattatcggaaggatatctatctaagttatttaaagaaagcttaggggcaacagtgaaagaatatttgagtcgtgttcgattatggcatgcggaagaacaattagtggaaacagactatccggttattgatattgctattggcaatggctttcctaacgtgaaatcattcaatcaagcttttaaaagaaaaaatgtgataactcccgcaaagtatcgtgaaaagatgagaaaatgacattcattagataataaaacgccattaatgtaagcgcttaaaattatataatatatatattgaaaaaggaggagaaaggatgtttaagaaaattttaagttgcttaatgagtgctatgatggtactgggtttaacaatactgccaacccatgccctagagggaacagcaacaggaactcaaaaagcttttgtcgtaggtgatgattggggtgctggtgtcactaaatccattatcacttttgacaaaaaaatcaaagcagattctatcagtaaaacagattttttagttaaagaaactgccacaaacaaagtaagtgatagaacaattttagatgcttatgcttctgatgctcagggaaataaagtaactactgattcaaatattgttacagtagaaatgtatatttctccaagtgaaggtaatccaatttcttggaataatctaacttggaaaaatgcatgggctgacccatatcagttagaaattactttggcagctggtgaaactctagtttctgaaaatgaaacaattacaacaattgatgtagatccaactattaacgtagctgaagatggtaaaatttgtcctcaattagatggttttaaaatgagtgaatttaccaatgatggtactactgtttcatatgctttatatacaccagaaaatgatagccataaaaatgctttagttatttggaatcatggtgttggtgaaactggaacagatgttcaaatcgatttattaggaaatgaagttacggctttggctggtgatgaattccaaaatacaatggatggagcatatgttttagtgccacaaagaagatcatatgatagtacatctaatgctgaagctatttatcagttgattttaaaaacacttagagaaaatcctgatattgatcaagatagaattattataggtggatgttctgcaggtggagcaatgacaatgaccatgattattgcgcatccagaattatatgcggcagcatatccaatttgtcctgctactcaaagtgcgaatgtgtctgatgaaacaattgaatcacttaaagatttaccaatttggtttactcatgcaaaaaatgattcaactgttgccatcgctactacaacagaacctcttgtagaaagattacgggcagcaggtgctgaagtacatacatcaatttttgatgatgtgcatgatacaactggaagattctctaatgaagatggaacaccatatcaatatgatggacattggtcatggacttattttgataataatgaatgttatgatgaaaatggtgttaacttatggcaatggatgtcagtacaaactaaagctgataaagtaattgcaagtggttctcaaaaggcctatattattggtgatgattgggggcctgcagtaacaaaaacagtaattagtttagataaagcaattgatgctgattctgtagttgctgaaaactttaaagttgttgaagaaaaagaagcaacaattaattggggaactggtgaaattggtattgcaactgcagatcgtaatgtaactgcagcttatacttctgatgcccaaggaaataaagtaaccggttcatctaaatatattacaattgaaatgtatgtttctccaagtgaaggatcaccatttatttataatttaaaaacaggatttaactcatggtgtacaccttataaattaaatgtaagtttagcaaaaggtgctacaatgagttcaggtgatgaagtagtaaccgatttaaatattaaagcagatattgacgttgcaggagatggaaagatttgtccacaaggtgaagtttttgaaatgaaggcttatactgctaaagatggtacaacgtattcatatgctgattatacaccagccaaagatgataagaaaaatgctcttgttatctggttacatggtgcaggtgaaggtggaacggatccatacattgatattttaggaaatgaagtaacatctttagtatctaaagaattccaaagcttatttgaaggtgcctatgtactagcaccacaaagtccaactatgtggatggatgatggaacgggtgcttatcaaaatggtgataaaggttcaatgtatgctgagagtttatttgaaatgattgatgcttatgtaaaagctaatgacgatattgacccaaatcgtgttattattggaggatgttctaatggtgggtatatgactatggaaatggttttaaaacatccaacatattttgcagcggctttcccaatctgcgaagcattccaagatcaatatattacagatgatcaaattaatgcaattaaggatatgccaatttggttcacatatgctaaaaatgatggtacagttgatccgactttatgtgtagaaccaacagtagcaagattattagctgctggggctaataatattcatgtatcagtatttgatgatgtgcatgatacaactggaagattctttaatgaagatggtacaccatatcaatataatggtcactggtcatggatctattttgataataatgaatgttatgatgaaaatggtgtaaatgcgtggcaatggttagctaaacaaattaaaactgctgctccagtagaaaccccagatcaaccaacaactccagatcaaccagcgaattcagtgaaaactggtgatgatgttaattttgcaggattaggagctattatgatgctaactcttgcaggaatttatgtatctcgacgtaaatataattaaattaaaagagctagatttgaatttctagctctctttttttgtttctaaaaatttaactttgatctcatagttgccatcaattcccggaattgcatttaaatattttttaattgtactttgtgttttagttgctgcttcgcttaataaaccattttcgattgcttcttcagctactgcttctttttgttttttagcaaaggtagtataatcattgacagaaattgggttgaatacattttttgtttcatcatatacttcaatactactctcgtcaatttcattacttaaaatttcaatttctggtattgaaacggtaattatattattattaatagctacttcaattttatccattttgacaccagctttaagtttaccgtcatatgtaattaaaaaacttttttgagttaaaggaatatcccagccattaaatgttaaattattagaaaatttaccaactttagtataattataggacattgttgccaattcttcgatttcttggagctgttgactcagaccagttgacgatatctttggttcactgctgcttgcaaatcgagttcccgcgtaaaaaatcagtaatgcaactagtaggattgcaatgattccaccaatagctttttttgtttttcctaatgtgtctaatattttcatttttatcacctagggatattataacataattcgacaattattgagaaaataaaaaagcccaaaggctttattatttaatgattgttccgtatacttcacgaccacatccagccgcatttgattcatctgtgtcaatatgcatagctgtagcataattttcactaacacgacaaacaacatcaccgaaaattaatgaacgtccttcagtttcgatttcaactttaacgatttgtttatcagtaactccaaattcaaccgcatcagcaggagtcatatggatatgtcttttagcagcgataacgccacaagaaatttcaacttcaccagctggtcctactagtttacatcctgcagttccttcgatatctccagattctctgatagcagcctgtaatcccaaagcacgagcatcagttaatgataactcaacttgagtagctttacgagttggtcctaaaacagacattttttgttcacccttagctccaactacagtaactttttcttcacatgcaaattgtccaggttgagaaagatttttcttattagttaattgatacccttttccaaataatgtttctaagtcagcgtcagataaatgaatgtgtcttgctgaagtttcaacgataatttttttagtcatagtcattctcctttttccttattctatattactccttttatcgctattttcaaggaaatagcgataaaatagaaaaaattttaaatttttttaaaaagattttagatagaaatttattaaaatagtaaaaataaattattataaatgctaaaaaataatcattttagtactaaaatggctgttttacggggttaaactaggaattatttttgtttttttaggatttttctaaaaaattcacatatctttacacatttatcgaaatagtgtattatggggctacataaaaagggggaacctatatgaacgagaaaaaaaatctaggattatacgataaatcatttgaacatgacaactgtgggattggtgcagttgtaaacattaagggagttaaaacgcatattacggtaagtaatgcattaaaaattgttgaacaattagagcatcgtgctggtaaggatgctgcaggtgagacgggtgatggtgtcggaattttaacgcaagtaccatatagttattttaaaaagacaattaaagaatttccattaccgttagaaggtaaatttggtgttggaatgttatttatgccaagagatgaacatttacgtaatcgagttaaaaaaatgcttgaaacaatcgtaattaaggaaggaatggaatttttaggatggcgtgaagtacctactgttcctaaagtattagggcaaaaagcacttgatgcgatgccttcaatttggcaatgtttcataaaaaaacctcatggaatcaataaagggatcgagtttgatcgaatcctttatcaaactcgtagaatttttgaacaaagcaattttgacgatacctatgtatgttctttttcatcacgaacaattgtttataaaggaatgttcttggttggacaattgcgctcattttttaaagatcttcaagatgatgaatataagagtgcgattgcgttagtccattcacgtttttcaactaatacaatgccttcttggcaacgggctcatcctaatcgttttattgttcataatggggaaattaacacaattaaaggcaatgctaataatatgttatgtcgcgaagaaatcatgacaactaatttgctggatactaataaagtgtacccagtcgttgatattaacggttcagattcagcaatgctggacaatacattagaatttctagttatgtctggaatggaattaccaagagcagtaatgatgtgtattccagaaccttatgataatgataaaagtatgtcacagtcaaagaaagatttttatgaatacaattcaactctaatggaaccttgggatggtccagcttcaattttattcagtgatggagaagttatgggagcggtacttgatcgaaatggacttcgcccatctcgttattatattactcgtgatgattatttgattttatcatctgaagttggagctttagatattcctgctgaagatattgttattaaagatcggttacgcccaggaaaaatgttattagttgatacaaaagctggtaagttaattgcggatgatgatttaaaagaaagttatgcccataaacagccttatggtgaatggcttgaaagtaatttgattaaattaaaagatatgcgcattcctaatgctcgagttgaacgttatcaaggggaacagctaactaagttacagaaaatttatggttatagttatgaggatgtaaatacgtatataaaaaaattagcattgaatggtagtgaagaagtagttgcaatgggaaatgattcaccattagcggtattatcaatgcagcatcccccattatttaattattttaaacaattatttgctcaagtgactaaccctccaatcgatgctattagggaagaaattattacttcaacagctttatgtattggaacagaaggaaatattttagctgataatgagaagaactgtcgcttgttgaaaatcgatcatccaattttaagtaatactgatttattgaaaatcaagaatattaagaaagatggttttaaagtagcagtattatcaatgctttattataaaaatacttcacttgaaaaagccttagataaattatttgtagaagcagataaggcttatcacgaaggagctaatattttaattttatcggatcgaggagttgatgaaaatcatgttccaatcccttctttattagcagttgcagcaatgaatgaacacttagtaaatactaaaaaaagaatgtctgtagccttgattttagaatctggagagccacgtgaagtgcatcattatgcgactttgattggatacggggctagtgctgttaatggatatttagcacaagatacaatttttgaacttgttgatgaaggcttactagataaagattactatgctgcaatcgaagattataatgacggtattttgcatggaattgttaaaattgcatcaaaaatgggaatttcaacaattcaatcatatcggggttcacagaacttcgaagcaatcggtttagctaaagactttgttgctaagtatttccctaaaacagtaaccagaatagaagggaagacaatcaaggatattgaaaatgatgttgattatcgtcatagtaaagtttatgatccattaggattagacgtcgatattacacttgatagtcgtggtgatcataaagaacgtagtggaaaagaagaacatctatacaatcctgcaacaattcacaaattacaactagcgacacgcaatggcgattataaattatttaaagaatattcagcaatgattgatgaagagggtaaaaatctaaatcttcgaggattattacaattcaaaaagggaaaatcaattccgcttgatgaagttgaaagtgttgataaaattgtacaaagatttaaaacaggagcaatgtcatatggctcaatttcaaaagaagctcatgaaacgatggcaattgctatgaatcgtttgaaaggaaaatctaatagcggtgaaggtggtgaggatccagagcgttttattcttgatgaaaatggtgatagtagatgctcagcaatcaagcaggttgcttcaggaagatttggagtgacttctcagtatttatgttcagcaaaagaaattcaaattaagatggctcaaggagctaaacctggtgaaggtggtcagttaccagctggaaaagtctatccatgggtagctaaaacaagacatagtacgccgggagtaggattgatttctccacctccacatcatgatatatattcaattgaggatttggcacaattaatttatgatttaaaaaacgctaataaggatgctagaatctcagttaaattagtctcagaagctggtgtcggtactgtcgcagctggagttgctaaagctggggctggagtaatcttaatttctggatatgatggtggaactggagcagcacctagaaactctgtatataatgcaggattaccatgggaattagggttagcagaagctcatcaaacacttatcatgaatgatctgcgtggccgtgttgtattggagactgatggtaaattaatgacaggtcgtgatttagcaatcgcaactttattaggggctgaggaatacagctttgcaactgcaccgcttgtaacaatgggatgtgtaatgatgcgagtatgtaatctagatacttgtccagttggagtagcaacacaaaatccaatcttgcggaaaagatttacaggtaagccagaatatgttgaaaactttatgcgatttgtagctcaagaattacgcgaatatatggcggaactagggtttaaaacaatcgacgaaatggttgggcgcagtgatttattagaagttcgtccaggtgttgaaaatgtagatttatctagagtgattaataatccatatattaaagctaaagaaatacgtcataatcctaaaaataattatgattttaaattagaagaagtaaaagatacaacaattttgttaaaagagtttaaaaacgctttagaaaaccaccaatcacatgaaatcaatgttgatataacgaatatcgatcgaacactaggaacattatttggatcagaaattactaaacgctatcaagatacattagatgatgatacattcaaagtaaattgttatggttctggtggccaaagttttggtgcttttattcctaatggtttaacattgacattgcatggtgatagtaatgattattttggaaaaggattatcaggaggaaaattagtagttgttccacctgaaaattcaaactttaaagcagctgaaaatattattattggaaatgttgctttgtatggagctacttcaggtgaggcatatattaatgggattgctggtgaacgttttgcagttagaaattcaggagctaaagctgttgtagaaggtgtcggagaccatggattagaatatatgacaggtggtttagttgttgttcttggagaaactggaagaaattttgcagccggtatgtctggtggaatcgcatatgtatacgatcctaataatcgtttgtattcacgaattaataaagaattagtctcttattcatctgtgacaagtaaatatgatgaagaagaattaagggccgttattcaaaagcattatgatcacactaattcagaagtagctaaagatattttagataattttggtgaacaagtatcaatgtttaagaaggttgttcctcacgattataggcatatgattgaattaataaagtattatgaaaagcaaggtctaacaaatgaacaagctaaagttgaagcattcaatgaagctaggaagggggtataaccatgggtaaaccaacaggatttttagaaattgagcgtcaagttagtaaggctgttgagccgaaaaagagaattcaaaattttaatgaatttcataagcatttgagtaaagatgatcaagcctgccaaggagcccgctgtatggattgtggtgtaccgttttgtcaatctggtcgggaattagaaggcgctgtatctggctgtccattaaataatctgatcccagaatggaacgatcttatttatcataataactataagcaggcattggcaagattattaaaaactaataattttcctgagtttactgctcgggtatgtcctgccttgtgtgaagcagcatgtacttgtggtttaaatggcgaacctgtaaccgttaaggaaaatgaatatgggattattgaagatgcttatgcaaaaggtttgattaaaccatgtccaccaactcatcgtattgataagaaaattgcaatcgtgggttctggaccggctgggttaactgcagccgatcaattaaataaacgtggataccaagttactgtctatgaacgggacgaccgtataggtggattattaatgtatggaattcctaatatgaaattagaaaaagaagttattgattgtcgtgttggaattatgaaggctgaaggtgttgtttttaaaactaattgtggaattgaagatgaaaagcaagctaaagaattattagataactatgatcgagtaatcctagcttgtggttcacggaagccccgtgatattgatgtaccgggacgtcaaggcaggggaattttaatggcagttgattacttgacagcaataacaaaatctttacttaatagtaatttaaaagataaaaattttgctccaactaaagataaacatgtactagttattggtggtggtgataccggtaatgattgtgttggtagtgcaattcgtttggggtgtaaaagtgtaacgcagttagaaatgatgccggaacttcctgctattagaagtgacaataatccatggccagaatggccgagaatcaaaaaaacagattatggtcaagaagaaagtattgctgttttcaatcaagatcctcgtatttatcaaacaacggtaaaagaatttattctagataaaaatggtcaggtaaaagaagcagtaattgtttcattagagccaaaagaaaataaagaaactaagcgagtagagatggtacctgttgctggcagtgaacaaactattcctgcagatttagttttaatatctgctggatttattggaactgaagatcatgtagctagagcatttaatgttacattgaatcctcgcggaaatgtaaaaagcaatcaggattatcaaacaaatataaaaaaattatttgttgcaggtgatatgcgtcgaggacaatctttagtggtttgggcaattaaagaaggtcgcgaagttgctcgagcagttgattttgatttgatgggttatagtaatttataaaaaaagatcatagcgaataagcagttgtttatccgttatgacctttttattttttgttataaaactaatgatggagcattgtaaacacgggcagctagttcactatcaagtaagtataatgagcgagaatcagaaccaaatagattaaatttagtaattaaatcattagcattggtttcttcttcaccttgttctttaacaaaccaatctaagaattgcattgtacgaaaatctttaagagaataggcagcatcatagagattatgaattaaactagtaacatattcttcatgttctaagccataaattagaggatcatttaatttagtatactctttatcaggtttatcgattgcttcaagggttactttagcattgttattttgaagatattgaacaaataatattgcatggtctctttcttcttgtgcttggatattataccagttggcaaacccatctaatccgttatctttatagtaattagcaaagtctaaataaagatatgcggaataaaattctttgttaacttgatcatttaataattctacaacttttttatctaacattttaattacctcctgtatatagtatagacctattttatttaattgttaatagatttaacaattatgtaacattagacaatatcattgttattgctctgttcactactattgggaatactagtaggattattagttttactgtctaaatttttggtagcatttatacagataaaggagatcaagattgtaagtaagcagctacttaagccgtagatccatttcttatcattgttaataaaaacctgatgttgagatagtttagacataattaaataaatgatagctagactagcaattaatgcacaaataataatactacaagttgctaaaattgaaattcggtatttactgttttgattattggctgttgttggaaagatactgctatcactgtttccaaaaggatttgtactattattagttgatgaatcattgtttccaaaaggattatcaccatcgagattattactgttcgtagatagtgatgtaaccgctgaactatttgaattaaggttataatccaagataactgtactaataccgctaatcaaagcagtaatgatcattatcatgcaaattagattatttttcttttttaacataactttcacctcacagtaatagtgtaagaaaagatagtatagttaaaatgtttacaatatgtgaatatatggcaggtttgtaaatctttatgtcattattttgtcggattaaagaatcttaattatttgacaaagggtttttaatttaaaatggataatggtataatagttcatgaaagtgggtgatttgatgccgttaatttctgcatttacatttaatataagttcaatccttaatgtaggtagaactattatagatttaattcttgtgtggtatgtaatttatttattgatttctatgatgaagcaaaatatgcgtacaatgcaattatttaagggagttttattgatcctaattttaaaaatgtttacaagtttattaagactaagtgcaatggattatttagttgatacaattcttacttggggtgtggttgcaattattattgtatttcagccagagattcgaggtttgttggaaaaaatcggacgaactaaattagaattaaagcatgataatcttagcgatgatgaaaaagaacgattaatggatgagctggttggagcaattactaaattatctgaggatcaaactggtgcattaataacctttgaacgaagacagtcgttaatagattatattaataccggaacaaagattaatgctgatattaaagcagagttatttacgacgattttttgggaaggaactcctcttcatgatggagcaacgatcattaaaggggatcgggttgtctgtgcggccgccttttatccacccaccaatcaggaattaagtccactatatggagctagacatcgtgcagccttaggtattagcgagataactgattcgcttacagttgtagtatctgaagaaacaggaacgatttcttttgccacagatggtaaacttcgaaaaattcctcgaaaagagttgcgagcaagtttggttaatgaactagattggttcaatactcaagaaaaggatggtgagtaagatgtcaaaaaaagaaaatcctaaaaatccaataaaaaaagattcaactactgatttctttttaaacttcattactcgtcagaaatcagaacagaaagatgaagaaaaaacaactacttctaaagtagttgatgatactgtaaaagtgagagataaagcatttgaattattctatcacatgatcaattctttaaatatatttttagatcgtatgttgcaatcaaatctttcaatgaaagttttatcgtttgttatggctgtcgttttactctttacaattaccggtggaattgataatatcttttcaacccctaatggcggggattatctgtatgatgtgaaaattgatactgaagggttacaaagtgactacgatgtagtaggattaccggaaacagtaaatgttgctttagtcggaccttctttagatatttactcaacaaagatatctaagaaatataaagtagttgctgatttctctactcttggggaaggtgaacatacaattgaattgcagggaaaagattttcctagtgatttgcaggtaatgatcgtaccacagactgttactgttaaaatcacacaaaaggttacaaagacttttgagctgggatacaaatttagtaatgaagatagcatggattctaaatattcagtatcagttgaatcaatggaacaccatgaagttgaagttcgaggttcacaagacaatattgataaaattaattctgttaaagcagtgattgatttaaaaggaaaaaataatgattttgaacaaaatgctaagatatacgcatatgatcgtagtggtaaaaaggttgatgtggaaattattccaaatacggtcaaggtagattgtatggtttcttcttatagtaaagaagtttccattgtccctcaatatacagggcaattagctagtggatatggttttgagagtattaaacttaaacaggaaaaagtaactatatatggtaaagaagaattgttgaatagtattaatagtgttggggttgtaattgatttatcgggattaagtggcgataaaagttattctaaattgccgcttactggtatagagaatattaataagttagattttaatactgttgatgcatctgtgcgagtatcaccatcaacaaaacgaataataactgatattccaatcaacattgttaataataatggtggatatcaagttaattttgctgaaggacaggacaaagcttcagtcgaagtagatggtgtggcagcaatcttagatgcactgacgatcaatgatttcaatatttcaattgatttggcaaacttgaaggcggggacgaatactgttaaagtagatttaaaaatagataaaggatatttaacggggaaattagtttctccagaaagaattacgattaccttaagaaaataggaggaaaaattaacgatgggtaagtattttggaacagatggatttagaggggaagcaaatgttgacttaacagttgaacatgcttataaagtagggcgctatcttggatggtactactctcaaaatggtaaagcaaaagttgtgattgggaaagacacaagaagaagttcatatatgtttgaatatgcactagtttcagggttaacagctagtggtgctgatgtttatttattacacgtaacaacaacaccttcagtatcatatgttgtaacaagtgaagagtttgattgtggaatcatgatttctgcttctcataatccttattatgataacggaatcaaaatcttagatggtaatggtcataaaatggatgctggagtagaaaatttaatcgagcagtacattgatggtttaattgatgaattaccatatgcaaccaaagatgaaattgggtgtgctttagattattcaatcggtcgtaatcgttatattggatatctgatgtcgattcccactagggcatttagaaattatcgtgtaggtttagactgtgccaacggtgctagtagtgcgattgctaaaagtgtttttgatgctctaggagctaagacttatgtaattaacagtgatcctgatgggttaaatatcaatactaattgtggttcaacccatattgaagtcttacaacagtacgtaaaggaaaacgcactagatattggttttgcttatgatggagatgctgatcgctgtatttgcgttgatgaatttggacgagttgtagatggggatctaattttatacgtttgtggtaaatatttaaaagatcacggagaacttgctaatgatactgttgttacaacaatcatgtcaaatcttggtttatataaagcatttgataaagaaggtattaaatatgaaaaaaccgctgttggcgataagtatgtaaatgaaaatatggttaaaaatggtcatgttttaggtggtgaacaatctggacatattattttctctaaacatgccactacaggtgatgggattttaacatctttaaaagtaatggaagctgttattgaaagtaaacgaactatcgcgcaattaattgaacctgttactatttatcctcaattaatgaaaaacgttcctgtaagagataaaaaagaagcacaggaagatcctgatgtaagagcggttattgctgaagttgaaactgatttaggtgagaatggtcgtgttttagttcgtgaaagtggaactgaaccggttgttagagtaatggttgaagcagatactgatgaaaaatgtcttattaatgtaaataaaattgttgataagatgaaggaaaaaggatttgtaatcaaaagataaaataacataatgtcacacaatattgccatataatatggcaatatttcatatatattaaaagtgaggtgaaatacatgcaatttagaataaatattattgatgatgaaaaaaatttaaatgatttagtaagaacctatttagaaaaagaaggatatattgtttattctttctatacatatgatgaagctttaatgcataaggatgatgatgttcatttatggttgattgatattatgttggatcgtgctagtggatttgaattatttaatgagattaaggctagtcgccctaaaatgccaattatttttatgtctgcacgagatcaggaatttgatcggattattggattagaaaaaggttctgatgattatataaccaaaccttttaatattaaagaagtgattttaagaattaataatttaattaaacgttcatatgatgatccatcaaaaattaagatggatggatatgatattgatttagaaaaacggcgcgtatttaatggtggagaagaagtaattctaacaacgaaagaatatgatttattagtttattttattactaataaaggcttagctatctctcgggaacaggttttgaataaagtatgggacgaaaactattatggtagcgaccgggtagttgatgatactttaagacgtttaagaaaaaaaatgccagagattaatgtacgcacgatctatggttttggctatcgtttagactaatgttaaataagttttctttgcagcgacagttaagcagattttctttacaaaagcagttaattattatcttttcattattagcgatgcttgttatattgattttagtaccgttgatcaataaaaatcttaatgctctaatagatgaagagatgtttaaaacgctagatacttcacagagcgcatatattgattttgattattcaccaatcgctaaatcaagtgataaacaaatttatcatatgacttatgataaaaatactaactatttatttccaccatctaatctaactcgtgataaagttttagcgttatatccagtatttgctgataaacttaatgagatgctaaaaggaaataaagataagatccaggctaaagggacacttgatggcgatactctttattttcaaataactaaaaaagatagtgattcttatatcatttcattagtatacagtgattactctgctagtttgatttcatcaattaggcaacaaataataaatattttatatgtatcatttgctgttattggcgcaattatttttatttgggttagtggcttaattaaaccattaaaattaattagaaattatatagaagacatacgtaaagataaacaaagtgaattaaagattgatcgtggcgatgaaattggttttgtttcagatgaacttgttgcgatgaaagaagaaatagataaacaaagcaagatcaaagaagaaatgattcataatatttcccatgatttaaagacaccgattgctttaattaaatcatattcacaaagcgttaaagacgatatttatccatatggtgataaaaattcatcaatggatataattattgaaaatgcagaacgtttagacggtaaagttaaaagtttattatatttgaatagattagattttattagtggtgaaaattctgatagtgaagttgatatgcatgaattaattgaacatattgttatccaattacaaggaatgcatcctgaaattgaaattgaaacagatttagctttcgtttcatttaaaggtgatgaagaatgttggcgtatttgtgtggaaaatatagttgataatgcttaccgatatgttgataaaaaaataaaaattattttaaaaaatgattatttagaaatatataatgatggtgagccaatcgataatgataacattgaggctctattccaaccgtatgaaaaaggaacaaaaggtcaatttggtttaggtctatcaatcgtacataagacatgtactatgtatgggtataatgtaacggcggttaatcaggaaactggagtaagctttattattgaaaagaaatataattaacaatccaaggctataccttggattttatttacgttataataagtgataataagtgggtgattaaatgttagacaaaaaaattgagttctttatagcgactgttgaaacaggttctttttctggtgctgcaagaaagttaatgctgtcacaatcggcagttagtcaacaaataaatttattagaagaagagttagctgttaaattatttgatcgctctaattatcgccctagattaactagagccggtgagttctattttaaaaaatgtcaggaacttgttgctatttatgaaaaaatgaatcatgaggttaaattgattgattcctatagtattcgtattgggataactggcccatttgaaaatcatcatattccttttttagttaaattatttaaagaaaagtacccacagatagaaataacaattataaaaggtagttttcaaagttgtaaagaatggttaaataataatcagattgatgttgcttttgctattgaaaatgattttattaatgaacctaaaattacctatgaagttttactgcagcatcaaatatgtgcaatttgcagttatgagcatccatgggctaagttaactaagatagcagcgcagaatcttatcaatcaaccgctaatttgtttatcaagaaagtttggggaaggcttttatcatgattttgtagaagcttttaataaagataagattgagccaaatattataaaggaagtagatactcttgatgagttgattttatcagttaagcttaatgaaggaattggtctaacttcacgtgaagttgttaatgaggaagaagtagcgattttagatattattaattcgcatcatcatgcaaactatgttattggttatgctagggatataaataatcaatttatttttgattttgttgcgctggcgaaaagatattttaataaaactctataagtaattcttataaagtttataagattatagctactattttttataattatctagctctataatattaatatatagatggaggaagataagatgtcaaaagtaatagtaacaggtgtagatggtaattttggaggctatgtagcgagaaatattactcagttaaaagaaaaagaagatttgatttttacttgtccatttgaagaaggactaaaggaatttaaagatactggcattgattgtcgagtagcaaattttaatcatccagatgaacagttagttgaagccttcaaaggtggcgatacaattttaataatttcagcaccatttgttggagcaaagcgtcaagcagcacataaaaatgcaattgatgcggcaattaaagcaggggtaaaaaaagttgtttatacatcattagtaaatgctcgtgatgtagaaaatcctagtattgaaaaaatcgatcatgcatggactgaagaatatatcgaaagtactgaattagattatattttccttagaaattcacaatatgctgaagcaatgataactagttatttaacatctaatggtaacttattgagttgtcaaggagatggaaagatggcatatatctcacgtttggattgtgcgatggcagcgatgtatgcactaacaaaagatgatatgcataagcaagttttaaatattaatggtcctgaattattgactttacatgaatttgcggcaattggaaatagagaaacaggaatggatgtaaaagttgtcgatgttagtgaagaggaggtatatgctggatttgatgctattggggtaccacgtactactgatggaacatttaaagatggctcaccagctccttattcaagtgatggaatggtaacttttgcaagagcaatccgaattggtaaaatggataattttactgatgattttgaaaaattaactggtgtaaaaccacgtacagtggcttatatgtttgccaataacagtgaatatggtgtcggagcaagaaattctacagatgactaattattagcttattaattggtagtgatattattgagaaatcaataatattactatcaatttttatttgatagaatatgtcaaataaaataccaagattatttaagaatttatttaaagaaatagaattattttatgctatgataaaattatggaggcggaaaaatgaaattattatttaaacagcgctttttttcatggctagatagttatgatatttatgatgaaatgggaaatacagtatacactgtaaaaggtgaattaagctggggacataaattacagatatataatgctgatggtttacctgttggtacaatcaaagaagaagttttcacttttttacctaaatttgcgatgtaccttaatgatgaatatattggtcaaataaaaaaagaactaacattatttaaaccatcattcattttagattataatgattggaaaatttctggtaatttttgggaatgggattatgaaatcattgattctcgtggtattgttattggagatattaataaggaattatttaattttacggatacttattctctaaccattagtgatccacgaaatgcaatctatgttttaatgattgctttagctattgatgcgcaaaaatgttcaaataacagttaataagacacgagagtgtcttgtttcatcttatgaaaaataattactaaattaatgaagaggtttataataataaccgaaggtggtaaaaatggggaaagatgaaaacaattttgcgcgtggcagtattccacgacatattataaatttagctggtccaatgatagtggcacagttgatcaatgttttatataatgttattgatcgtatttatattggaagaattccagatgttgcgacattagctatgggaggactagggctatgtttgccactgatttctattattattgcttttgctaatctatttggtatgggcggtgctccactttgttcaattgctcgaggacgtggtgatattgaagaagctgaagaaataatgggtaattctttcatgctattaattatttttgggattgttttaacagttattggtttgatctttaaagaagatttgctgtggctctttggtgccagtgaacatacaatcggttacgctaatgattacatgactatctatttattagggacagtttttgtactgattggtttaggtatgaatagttttattaatagtcagggatttgctaaaatcggaatgatgactgttttgctgggagcaatagttaatattattttagatccaatttttatttttggactagatttaggggttaaaggagctgcttttgcaacagttatttcacaatttatttctgcattatggacattacgttttcttacagggaaaaaaacaatattaaagataaaaaaacagtatttgagtttaaaagtaaaatatgtcacaaagattatttccctaggaatggcagggtttatgatggcaatcactaattcgattgtaacaatcgtatgtaatgcgacattgcaacaatatggaggagatctttatattgcaattatgacgatcattaattcaattagagaggttgcttctttgccggggcaaggaatggcaaatgcttgtcaaccagtattaggatttaactatggtgctaaagagtatgcacgggttcttcaaggaattaaatttgtaactttaacggcactatcaatgatgctgatagtttggctggcaataacggtatttcctgaattatttattaagatatttagtcataatcaagaaatcattacccatggcgtgagtgctttacgtttgtatttctttggctttttcatgatgtcatttcagatgacaggacaagcagcagcagttggattaggaaagtcaaaacaagctgttttcttttcaatttttagaaaagtaattattgttgccccactaacagtgatcttgccaatctatattggcattgatggagtttttattgcagaagcaattagtaattttattggtggtggtgcctgttatattactatgtggtttacaattgcgaaaaaattaaaatcgggtattattagtgaataatagtaaaaggattataagtgttataaatcgctaatcaataatattagcgattttctttttaaattatgaaaaaataaatattgtcaaataaatgatgataaaatcatggtaatttggaggtactaaaatgaaattaaaagaaaattttttatggggtggcgctacagctgcgaatcaatatgagggtggctataatgaaggtggtcgtggattaagtattaatgatgttgaaaagggtgctaaacatggagtacctcgtgaaattcatgagtgtattcatgaaaatacatattatccatcacatgtagctacagatttttatcatcattatcaagaagatattaaactatttgcccaaatgggtttcaaatgttttagaatgtcgatttcatggtcaagaattttcccacgtggtgatgaagaacaacctaatgaagaaggtttggctttttatgataaagtatttgatgagttattgaaatatggaattgagccagttgtaaccctatcacattatgaaacaccattgactttagttaatgaatatggttcatggagaagtcgtaaattagttgatttctttgagcattattgtaagaccgtattttctagatataaggataaggttaaatactggatgacttttaatgaaattaatggctgtttagaggtggctcgtccttggcatcaagcgggaatcgtttatcgtgatgatgaagatcattatcaaacaattctccaagctagtcatcatatgtttgtagcaagcgctaaagcagtgattgcagggcatgaaattaatccaaattttaagattggctgtatgttaatttatccaacaacatatgcagcaacttgtaacccggaagatcagattatgatgagaaataagatgctaaatactttctattatggtgatgttcatgttcgaggacgttatacaaatacatgtacttcattattgcataaacatggtgttgaaataaaaatggagcctggagacgaagaacttttagcgaaaggtaaagttgattatattggttttagttattatttttcagctgttgagggtaatgatgctgaagaaattgaaggaaatgttgttaaaggtggacgtaatccgtatttaaagatgacagattggggttggcaaattgatccattaggattaagaacagctttaaatgagttatatgatcgttatcaattacctttgtttattgtagaaaatggaatgggagcagtagatacagttgaagtcgatggttcaattaatgatgcttaccgtattgattatattaaagaacatatcaaagcatttaaagatgcagttgagattgatgaagttgatttaatgggatataccccttggggatgtattgacttagtggcagcaagtaccggtgagatgagaaaacgttatggttttatctatgttgataaggatgatgagggtaacggaacccttgcacgtaaaccaaagaaatcattctattggtatcaaaatgttataaaaacaaacggtgaggagctgtaatgacttaggtcgttacagttttttgtagaatgtgttaaaatattctacaaaggggagagttttatggaaaattattgtcgcaaaatggcctggctcttatataatagagggctagtcgataaagaaaatgttgaagatctgcgctttttgctcgaacttattttgacacaggttataacgatcatatcagtctatataattggtctattatttatggatgcactgagtatcttgattatttgtgcctgttttgtagccgggcgaaaatatctagatggttatcatgccgatacttttagaaattgttatttactgacgatgttaaactttattttttgtatttttatgagtaggatagtagcatatgttgaaatattttattttataggaataggaatatcattatatttattatttaaatatagatataaaaaaataattatttttaatttattctatatattgataatagtattatttaatacaggtatagtttatcaaatcaatatggttaattattttgtaatagtattgatgagagtgataagaggggaggaattaaaatgatctctattgggataatcgatgatgaacaagtatatttagataaaattaaagatattttaatcacaaattttgatgacattagagtctattcgtataattctgcgagtaaaatagataatgatctagattttatattacttgatattgatatgcccgatacagatggaattattttttcaaaacaacatcgtaattacagaattgtatttgtgactaattatgatactcggatcaaggaagcttttggacctaatgtatatggatatgtatcaaaaggaaatcttgaagaagaattagtagagaaagttaaagaagtgattgaggtaatcaaatgtgattattatgttacgtttaaggtaaatggaatagatataaatattagggttgacgatataatttactgtcagtatttaggtaatcatattgtttcaatagtctatcatgataaaaaaattaatattaataatagttctttgaagaaagtaaaagaggttttgaatgaatattttatagaaataagccaggatataataataaataaacatcgaattattaattttgaagatagatatgtgtatctagatggaatcaacagtaaatttgaagtaagtgtaagaaaaagaaagttagtgagaaaaagtttttacgagacatttagatgatagaagttattagtgaatatttttattgtttaatttatgttatcgcacttacatttactgcgagttatctattagaggaaaaggttaaatttaaaagagtagttataatggcaccgctatatgcaattgtaaattatcttgtagcaggggctactagtaataatttttgggaatacatgattgtgaattctattatcatagtcatagatttttgctatatttgtattttatttaaaaaaacaaatgtaatattctatgtttctttattccagttattttatatatttactgttaattctctaatccatgttattaatattattattggatttaaccgtgaggttacattatcatttagtattcaaaggcttatcatggtttttttaataaatatattaacagttatttttattgttgttttggataaattaaagattattcccactcagaaagtaataaatcgtcaagtaaaattatttatcatgctcgatatattagtttattatgcgatggtaattatatataatattggtgtagtaagattggttaatttaattacagtattagtgttgattctattatttttgtggataatgtttttaaaaatattgtctatgtatgttgaaacaacaatcagaaatgaagaattgataatggaggatatatctaataaatatataagtaagtatcttgatttttataatcaggaaagtgataatttaagaaaattaaagcatgacctaaagaatcatcaacttgtattagaaagtctagataaaaagaatcaatatactcaatatattgatgaagtatttaagggaattggtcaagtaacatatattgaaagtggtaatatttatattgatgcttgtttatatgctaaacaacaagaatatcctgagataatttttgattttgatataagtgttgcgggtttggtatttaatgaaaaagatttaacatcattaatatttaatttaattgacaatgcatgtaacgaagcattaaaacacaataagttagtatcagtgatgattagatatactaataatttattaatcattagaattaagaacacttgcccgattaagcctaattttagtacggataaaggtgaagggcatgggtatggattaaaaataattaaaaatattgttaataaatatcatggtgatttgtttatcgattatcatgatgatcaagtaatatttaatattaaaataaacacttaaggaggtatttttaacatatgaggaggtgtaaaaaaacattatctcgatttatgttatattttagaagtgaggaggatatgtagatgaaaaatatgattaaaaaagttattaaaaaaagaatagaaaaagtaaaacttaatggttataattgttcaccttgtgattattatagaccaaaaaaaccaagtaaataatagtacaaacttttgggagagggtaaatgtactaaatagtaatatttattaatggcatagccaaagcaaaaatttatataactaagattcaatataatcaatttctataaagatagaatcgtcgtacatatacattaaatgggataaagcgtatataataaaaagtgatttttattattactgagggttgttagcatggcttttttattatagagacgagattttgaacctttgtttagtaaattatgttataaaatagctggattaataatatgttcgattaaaaagagatattaattatttaatatctctttttagcgtgtgccgggcatggctggcatgaattcagttagagataaaccaaccacaggtagttaccgtcaagcgtagaaaaccacaacctgttgacagtaatgacatgggtgaaggaagtaatgtgatgtagcgattcttttgaacatgtgaacaggaacttaatgaggctaaatggtggataaggttgcgctacaaaccaaagtccaaatggtatatgtaagactaagacagtaaatcaagacattgtgaaagaattaggattcatgctctacttcgagaggctttatggacgaggaagtctagtaaactttaaaatcaatgatagtatcctcggtagaaaaaggtttatcgtaagaagttagatgaagtcatagtaggtagagatactggaggactaaaacgtttatagagtgcaaatttagtaatgaagacatctttaaatgtgctaatatagaattagggcggtatagtaggatgaatgtcaaatgtcataaactttattatattaccgaaaatattaggtattaagaaagggaaagacctggattggtacatcgcctaaattactatcttaagagtttgtaatttgatataaatgtagagctgtatactagacctgcacgtacagttcaatgggtggggcaataaattattttattcctttaacctattactgattatttagaaaataaaaaatatttaaattgttgatgagccagggaataagttaaaaataatatagtattattagccatgttaggatatcctgatatggttttttatgctataatagtactattttatatagtattaatcaaaagttcattaatagttaataataaataaatatacttaggtcgtataaaataaaattagggagcaaatatgaaagaaaagttctatcgctttatgcaaggaaggtatggcattgatcaattaaatagttttttaatgattgtctgtgtcatttgttttatcgtaaatatgtttattggcagtattgttttaacttttattgcttatggaacatggctatttgtaatatttagaatgtttagtaaaaatatttatgcacgtaatcgagaaaatgacaaatatttaaatttctttagtccacttagtcggtggttaaaactaaaattgatgagtaaacaagatccaagtaacaaatattttagctgtcctaaatgtaagcagatggttagagtgccaaaaggacatggaactgttgtagtaacttgtcccaattgtcaaaacaagtttgaaaagagaacataaagatgtttggctacgttgttatcaataaaccagaattaaaatttaaagaatttgatgtttatcagtcatattactgcggattatgcaaaactcttaaggaaaagtatggtagccgggctcaaatctctttgaattttgatttgaattttattagtatcttattgagtggcttgtatgaaccggaaactaagataggggaatcacgatgtgttatgcaccctttaagtaagcatacgactcgttacaatgaatgtgttgattatgccgctaaaatgacgattgttttaacatattttaaatgtgaagatgattggttagatgagcgtaagattagtaaacaggcatataaaaggttgttaagaaaagcatatcaagaaattaaggaagaatatccagataagttggcacatatcgaaacttgtttacattgtattaatgactatgaaagtcaaggaattacaaatcttgatgagatttctaaatattttggtgaagtaatgggtgaaatatgtgcttataaagatgatgaatggcatgatgaattatatgaatttggattttatttagggaagtttatttattttattgatgcttatgaagatattgaacaagatttaaaaaagggaacatataatccgtttaaagaattatatcaaacggatcagtttgaggataaatgcaaagatattttagaattaatgatatctgaagcaaccatggcttttgaaagattgccaattattgaaaatgccgcaattataagaaatatcttgtatggtggggtatggaataagtatgaattagttagacaaaaacgattggaaggtaggaaataatgaacccgtatcaaatattaggaatatcatctgatgcaactgatgatgaagtaaaaaaagcatatcgtacgttgagtaaaaaatatcatccggatgcgaatattaataatcctaatcaagctgcgtataccgaaaagtttaaagaggtgcagacagcttataaaacaatcatggatgatcgtaagcgtggttttacaaatcgaacttatggcaatacccaaggtgcggggtataatggacaatcacaatctagctatcagtataatggtaatgatcaagctgcttttaatgaggctgctggatttattaatgctcgaagatttcaagaagcacttaatattttggaacaaattaagactcgtaatgcaatgtggttttattatagtgctgtagcaatgaatggaattggtaataacattacagcagttgaatatgcgcagacggctgcccaaatggaacctggaaacttgcaatatctattatttttacagcagttaaaaggtggtcaaagacagtaccagacagggcagcagacttatggttcgccttttggcagtacaatgcagtgctgttatagtattatgttacttaattgtatgatgaattgttgttgtggtggccggatgtgctagaaggagatatgattaatgagtaaagtaattggaattgacttaggtacaacaaatagttgtatggcttacatggaagatggtaaagggattattatcccgaatgcagagggaaataaaacaacccctagtgttgttgctttcactaatgatggaaaacggttagttggtgaaaatgctaaacgtcaagctgttactaatccgctaaatacagtagcatcaattaaacgtgaaatgggaactgcatatcgtaaaaatattaatggtaaagactatagccctcaagagatttcagcaatgattttacaaaagctaaaaattgatgctgaggcttatttacatgaaccagtaacagaggcagtcattacagttcctgcttattttaatgatgcccaacgtcaagcaactaaggatgcggggcgaattgctggtttaaatgttaaacggattattaatgagccaacagcagcagccttagcttatggcttagaaaatagctatggacaaaaaatcatggtatttgatttaggcggtggaacatttgatgtttctattatcgaaattggaaatggagtaattgaagttttatcaacatctggagataatcatttaggtggtgatgatttcaatgaaattatagctaagtatattgttgatgaatttagaagaattgaaggcattgatttaagtcatgatcaagtagcaatgcaaagaattaacgaagctggtgaaaaagctaaaatagaattatctacaatgattacgactattgtgaatcttcctttcattactaatactagtagtggaccaaaaaatttagaggttgaaattagtcgagctaaatttaatgaattgacaaaaggcttagttgatcgggttgttattccaatgcaaaatgctttaaacgatgcacgtttaacaccacaagaattaaataaaattattttagttggaggttcttcaagaattccggctgttcaagataagattaaagaaattactggcaaggaagcaagtaaatcattaaatccagatgaatgtgtagcccaaggagctagtattcagggtggtaagttgtctggtgatatagcagctactggaaattttgatgttctattacttgatgttacaccattgactttatcaattgaaacgatgggtggtgtggcaacgccattgattgagcgtaatactacagttccaacgagtcatagccaaatttttacaacttctgctaacttccaaactcaggtagaaattaatgttcttcaaggggaacgtccattagccaaagataataaaagtttaggaaaatttaaactaaagaaaattaaacgggcaatgcgtggggtaccccaaattgaagttacttttgatattgatgctaacggaatcgttaatgtatcagctaaagatttagcgagtggaaatatgcaaagtattactattgaaaatacttcgaatatgtctgatgatgatatcgaaagagctattcatgaagctaaacagtatgaacagcaagatgctgttactaaagagcgtttagtttttaaaaatgaagttgaaaatttgattcttacggttgaagcagctttatctaaaaatggtaaacaaattgataaagcaatgaaatcaaatattaaaaacgaacttgcaagctttaaaaagttaactaaaaaagttgattttgaaacatgtgatcagattcagtttgatgaaatcaaaacagcaaaacttaatttggaaacagttgcagcatcattgttatcaatgcaataatccttggttataaccaaggattttttaggaggaaaatatgatagacgagattttagcttacaatcgggcatttgtgactaataaaggatataagccttatacgacgagtaaatatcctgatcgcaaattagcgattgttacttgtatggatacccgtttgattgaattattaccagcggctctaggaataaaaaacggagatgcaaaaatcataaaaaatgctggtggagttattgttcaccctttcggtagtgcggtacgaagtttattgattgctatttatgaattgaatgttgaggaaatcatgattatcggacatactgattgtggagtaggaagtatcgatatagaggcaatgttaaagaagatggaaaagcgtggaatcagtgaaacggttattagggatcttggatattgtggaattgattttaataaatggctgggcggttttgatgatgttgagatatctgttaaagaaagtgttagtttgttaagacgacatcctctgttgcctaaaaatattgagattcatggactagtgatggattcaaggacgggcgctttaagtttagtggaaaaaaattgattttttttgtttaaagagcatcatgagattctagttttgttactagaatcttttaattatgtaaagaaatacggtataatggaaaagtagaaatatcttaacttaatatatcttgtcttgttaactatttcacttgacaatgagtatgatttgtgggatattttatctaatgtacgagaactttgaaattaagtaaatggggaatagttaaatgaatgatattattgaagaaattcaaaagttaaaaaaagaaaaaaatgctgtcattttggcacattattatgttgatggtgcaatccaggatattgcagattatttaggtgattcttactatttatcaaaaattgctgttgattgtccacaagatgtaattgtttttgctggagttgaatttatgggtgaaagtgctaaattattaagcccaaataagacagttttaatgcctgataaggatgctgattgtccaatggctcatatggttgatgaatattttattgcccgtcttcgtaaagagtatgaagatctatgtgttgtatgctatattaactcaactgctgaaattaaaacaatgtcagatgtttgtgtaacatcatcaaatgctaagagaatcgttgaagctctaccaaataaaaatattttatttattccagatcaaaatctaggaaaacatattgctgaattagtaccaagcaagaatttcttattctgtaatggatattgcccaacgcattatcggattacaccagaagatattttaacagctaaagaaaaacatccgggggcacctgtattgattcatcctgaatgtaaaccagaatgtgtagagttggcagattatgctggcagcacttcgggaattattgattatgcaacaaatgatcaggaacatgatgagttcattgttgtcactgaaataggcgtgattcatgaaatggaaaaacgtaatcctggaaagaaattctatccagcaactgataaattagtatgtccaaatatgaagaaaaacacgcttgaaaaagtacgtgattgtctaaagaataatactaatcaagtagagcttgatgaagagtttatggaaaaagctaagaaaccattggaaagaatgcatgaattagcaaaataagaaggtgtaaataatgaataataattatgacgtaatcattgttggaacaggagctgcagggttatttgcagggttatgtttacctgctgatttaaaagttttaatgattactaaagataaagttgaaaatagtgattcttatctagctcaaggaggaatctgtactttaaagagtgctgatgattttgatgcgttttatcaagatactttaaaagccggtcgtaacgaaaacaatcctgaatcagttaaaatcatgattcagcaggcacctcaaattatgaaagatttgatggattatggtgttgaatttgatcgcgatactgaaggaaatttagcttatacacgtgaaggtgctcactcggaatatcggattttacatcatcaggatgttactggtaaagaaatcacttctaaattaattaaacaagttgaaatgcggaataatatcacaatggtagaagatgctacaatgctggatattattaatcatgataatattgcaacaggaatcgttatggaaaataatggtgaaattattcaaattaatgctaaagttattattcttgcaactggtgggattggtggattatttacccactcatctaattttagacatatcaccggtgacagttttgcaattgccttaagaaataatattgaactggagaatattaattatatacaaattcatccaactactttatatacaactaaaccgggtagaagttttttgattagtgaatcggttcgtggtgagggggcccatttattaaatcctgatatggagcgttttgttgatgaattattgcctcgtgatgttgtaagtaatgcgatcaaaaaagagatggataaatataatgtaccccatgtttatttatctgttacacatatggatccaaagcaaatcaaaaggagatttcctcacatatatgatcaatgtcttgctgagggttatgatatgtttacggatccagttcctgttgttccggctcaacattatttaatgggaggaatcaagagtgatacttacggacaaacttcaatgaataatctttttgcagttggagagactgcttgtaatggggttcatggcgctaatcgtcttgcaagtaattctttattagagagtttagtttttgctaaacgagcagccaaagttattgctgatggtattgacaagattagcctttacgaaaaagtagtagatttagatggctatgataaagaaaagttaaaaaaagaaaataaagaaataattatgaatgaaataaaaagaaaagatggtgaattctatgataaatggtgtaaatcttaaggtaaacattgatgattacatcttaagtgcgttgaaggaagatatcacgagtgatgatgttacaacaaatgcagtaatgccagaagctaaattaggacatgttgatttgatttgtaaacaggatgggatcgtttgtggtttagaggtattcgaacggacttttaaattattagatgaaaattgtaagtttacaacaaaatataaagatggtgatgtaatcaaaaatggtgattatatcggtgaagtaattggtgatattagagttttattatctggagagcgtgttgctttaaattatttacaacgaatgagtgggatcgctacttatacaagtgaatcagtagcaatcttaaaaggatctaagacaaaattattagatacacgtaaaactacaccaaacaatcgaattttcgaaaaatatgcggttaaaataggtggtggaactaatcatcgttataatttatcagatggagtattaattaaagataatcatattggagcagctggaagcattgctaaagcagtggcaatggctcgtgattatgccccatttgttcgtaaaattgaagttgaagttgaaactttagaacaacttcaagaagcacttgaggctaaagcagatatcattatgctggataatatggataatgcgactatgaaggaagcagtggcaatgattggtgataaagctcagagtgaatgttctggaaatgttactaaagagcgcttaatggagattgcagagattggggttgatttcgtatcttcaggtgcgattacttatgctgctccaattctagatttttcaatgaaaaatttacgaccatattaaatagataaagttaattgggctggtttaaggaataatcttaaatcagcttttttagttaataaaaattattttatgattaattaaaaaaagtgtagtttattgactaattaaaagggcatacttaatctggtgataaaatggaaaatgaatcatattggcagcatacgattacgctgcctaaatacccgcagataaacaaaaattgtaactatgatgttgttattgttggcggtgggattagtggtgtaagtttagcttatcgtcttaataacagtaatttaaaagtagcattatttgaaagtgacacacttggtagtaaaacaactgggcatactacagctaaggttacttatttgcatggtgctgtttatgctgatatttatcaggtctatggccggagtaaagcaaaacagtatttagaatcaaattatgaagcttatcaggatattaaaaaaataattgaaatggaacaaatcgagtgtgattttaaagaaaatattgcttatgtaggagcaagtgatacaacaaatgcaaagaaacttgactgtcaaatcagattatttaaatcttggggatttgaggttttagaaaatcgattgaagaattgtcagatttctatgggacttaaacagcaggctatttttcatccattaaaatacctaaaaggattactagcgcaatgtaagcatattgacatttatgaacattcattagtaacaggcagcatgcatcaagatggattggtatgtttggaagttaatgggtttaaagttcaggcaagacaggtagtttggatgactcgctatcctcctaatttacaacatggttatttttttagaattattcaagaaaaagaacatgtcatttttcaagaaggacagagtaatggtaatagtattttagatttatcgactaattattctaaacgatatttagatgaacagcatattttaatgataaaacgaattgatgatcttaatcaagtttactggtatgcccaagatggaaagccgttaagaaaaataccttatattggtaaaatgaatggacaagaatatgtggcctatgcttataataagtgggggatgacgttaagtcatgttgctagtaaattaatttatgacttaattattaatgatgaaagtaaatatgcctctctatatcagcctagttatggcaattatttaaaatctggggcggatatgctgaaactagttaaaaataattatcatgggatgataaaaaatcgtttagtttctagtaaaaaattaaagttaaagaagcagcagggtaaagttattcgacatcaaggacgattattagcagtttataaagatgctcaggaacgaatattttatttctcgccatattgtccgcatttaaaatgtgtggtgcagtataatgagattgataatacatggaattgtccatgtcatggttctatctttgattgtcatggaaaacttgtaagtggaccggcaactaaagatttaaaacaatattgaaaaagcatggagtttaatcttccatgcttttattacggataaaatattcagttaatctaagtggctgttttaaaccgtcaattagattactaggatcattgattttaacatgatatttaataaaaggctctaaaaattgtatataggcttctcttgtatcttcagtgacagtaataatgaaatttttttgatcgttaaaaattagtttaaactttatttctattccgatatcattagttcgcataaaagaaacttttctaactataatatttagttcttcaagattagcataattacgtttagataagtaattctctaattcattaagatcatctttcataaaaaataatttcatccggtcatgaagatttagtttttctttgtataacataaaattattataaaataaatagatactagaattacgataactataaacaaagcctagagtaattaataaggaaattggataaataataaaactaaatgagtgatctactgctattccgttagtcacaattaaattcttaaccatcatggtaattaaaaaaggaatagtaataaaacaaattaacttaaatactaatttgattaaagagggaatttgatagccgcatctataaattggttccatcatcttcaacatccttttttcgttttaacatatcttgataagaatatacgcagccacaataactttgacgataaagatgatagctgtcagcaaatcttaccgattttaaataaccattatttttcttaaaatcactaaataagaattttgttttattttgagcaaaacttgctccaatttcattgatccattgactatttttatgaggtgaaacactcaatacagttgtccaataatcaaaattgtgttcacagctatattgaaaggcatcattcatccttttttgataacaaagataacaacgtttccctccttctggttcatctttgtatctactaagcttatttaaatattcttttggtaaataaggttgttcaataactgtgatattttgatgataatcttgattaaactgtttaataaagctgagtaattcttgataacgacgatgatattcagcatttggataaatattagaatttgaataataaatcgtaatttcaaagatatcagctagttctctaattacattgccgctacaaggaccacaacaaacatgtagtaagagacgtggtcgcgtattttttatttttgttaattcttctttaaattttaagtcataatttattttcataaattgattatagcatagtttattcttgaacgtataaataaattttatggtttaatatatgcaaaaccttcagtttgtttttgtgctaattcaacaacaccagctggaacgatcgtaataaattgataaatatcagcagcagtgaggtgattagctgctaaagcattgttacatgctgtaaaagttacgtgtttttttgataatgcggtaaaaatttttgctatttcatgatcataatcgagctgataggcgataactgcctcactgtttgcaagaacttcgatttgataatcgatattttggacttgataataattgctcatattagtaacattgcctaaacaaagttgccattttgttaattcatcaacatgaaagataattttcatcatatactcctttaattaaattaaacaattgtatttactggtagcatctataaaattgttagtgattatttggcgctctaaataatatttagctagttgttcgtcattcatttgatctaattgatcatagaaataaagaattaattttaaatattgtagatcatctgagtcgagatgctcaagtaataatgtttgggcttctaaatatttatgttgctccattagttctttgatttttaaataaattaaatcgctttgagtataattagactcacctttaatagtataacttacagtttcgctattaaaaaataatttagctaaagctctggcagcactttgaatttgacggataataaaatcttctttatgatatgaaaacatgttctcacttcctctacttttaattctatcataataaaagaaaaaaatgtaaatctctttaagatttacattataaacatactatcaccaaaactaaagaaacgatatttttcatcgattgcttcctgataagctttaaaaataaattctttacttgcaaaagcactgatcaacattaataaagttgacttaggcaaatgaaagttggtaatcaaacagtcgattgcttcatatttataacctggataaataaagatatcagtattttcatgaacagatgtaaattttccatattttttcatattagcttcaagtgttcttgttgaagttgtaccaactgcgataattcgttgaccgttttgtttagcttgatttaatttgtcagcaacatcaggttcaatcatataatattcactgtgcatatgatgttctagaacatcatcaacttttaccggtctaaaagttcctaacccaacatgtaaagttacatcaaggatttcaattcctttagctttaattttttcaataatttcatcagtaaaatgaagtcctgcggttggagcagcagcacttccttcaattttagcataaacagtttgataacgattttgatcatctagtttttctttaatataaggtggaagtggcatcgttcccaattgatctaggatttcatagaaaattccttcatagatcatcttgaatactcgaattccttcttctttaatctcgacacattgagcttttaaaaggccatcaccaaaagtaattatagtatcaattttaacgatccgagcatttccaactaaacattcccacatatcgttgccttgatcttttaatagtaggacttccacatgaccgttagtttcttctttaattccaaataaacgagcgggtattactttagtattatttctaactaggatatcaccaggttttaaataatctataatatcataaaaatgtttatgttcaattgtctgctgattacgatttaagaccattaaacgtgaagtatcgcgtttatctaatggggtttgggcaattagttcttcaggaagattaaaatcaaattcacttattttcatcttaaaaagccctcttatatacgtcatgaccgtacttatctaaaaattcttctttaaagtcaagtaagcgatcttctttaattgcttcacgaatatcacttgctaacttcagtaaaaagttaacattatgaatcgatagtaatgttttaccaaagatttcatcacatttatgtaaatgacgaatgtatgctctagtatagtttttacaagcataacagtcgcattcagggtctagaggtgtaaaatcatatttaaatttctcattattaatatttaaacgtcccctgcttgtcattattgcaccgtggcgagctacgcgagtaggtaacacacaatcatacatatcgattccacgaatggcacattcgattagatcaattggattgccaactcccattaaataacggggtttatcttcaggcaaccatttgatagtatcatcaaccattttatacattacatctttaggttctccaacactagtccctccgatcgaataaccggggaaatccatcgcgactaattctttagcacactgttctctcaaatcagggaattcaccaccttgaacaattccaaataaagcctgtttttccgtgtttttgtgtgcttcttttccacgttttgcccatcgtaaagttcgttccatgctatttttcatatattcgtaggtacatggatatggggcacattcatcaaatgacataatcatatcagcacctagtttattttgaatttcaattgctttttctggtgataaaaacaatgaacttccatcaataatacttttaaattttacgccttcttcttcgatttttcgtgttttacctagagaaaaaacttggaaaccaccactatcagttagcattggtccgttataattcataaatttatgtagtcccccagctttttcgacaacatcttcaccgggacgtaaccataggtgataagtattagccaacaccacttgtgagtgcatttcttttaacatttctggggaaattccttttacggtagctagcgtaccaacgggcataaacattggagtttcgacatcaccgtgaggggtatgtaaaattccatagcgagcacccgattgtttacaaacgtgttttaattcataagttattgctgccataatcatcctccttaaagcaagcattattataacgcaatcttgctctatttacaattttagtttgcaataataaaaccctataaaattatagggctaaataagatttaaatgttgtaaagcatggtaaataccatcttcttcaatatctttagttacataataagcaagtttaaataattctggttcaccatttcccatcacaatcgcatgtttaacatatctaagcattgcttcatcgttaaaactatcaccaaaaacataagcatcatctttatcaagaccaaagtaatctagtaaaaattgaattcctgtagctttagagcatcctaaaggaacaatttctccaaagtcttctgctctagtaatatattcaaaatcttttgtaatctcagacttaaaagtttcaatatctccatgttcatcaaaccagacagctagtttatcgaatgacaggttagggtcatcaaaagttgataagttaaaagttggtgtagcttcatagcgctctttgactccttttaaaaaggggtgacgaatattttgatcaaaataaacggtattttttccttcaagaacaccttcgacattagtttttctaatcaaatctcgaacttcaaaacatctttcttgactcaatgtttttgaaaataacacttcatcatgataacgaatatatgttccacaaccacaaacataaccatcaggatataattccttgatacactcatcaattgatgaaaaaggtctgcctgtattaataaaaatcaaatgtccttgttcttttgctttttgtagtccttcaactgtacttttagggatagtgtgtgttgtttctgataagattgtgccatctatatcaaaaaacataattttatttgttgccataattacctccatgataattgcattatacaataacttacttttatcaacaattgattatctaaaatagaaaaaatatttaattaagccgctaattaaatatttctaaaagtatatttcttatatgaagcaagagaatctttgaatctacgtttactaataggcaacacggtaccatcttcaagagttgtacttttattctcaatattgataacatatttccagtgaactaagtaagactggttgatcatataaaaatcttcacagttaataatgctttcgatattagatagtttatatttatttgtcttaataactctatcagttgtgtgaatataacaaatatgaccataactttcacaataaagaattttcttacatttaatagttgttaaaccatttttatcttgtaatgatataacacgattatcacgatttaatttagaaattaaatgtttgattggctggatcaatcctgtttcaagattttcttttttaacgaaatcaaagggatgaacactaaaagcattaaaaacaagatcatatttattagtaatgaaaataatagtagtatcattatggttctggagatagttttgagctaattcaatcccatttaatgatggcatatcaatatctaagaacagcacatcataatatgtatccatatgaagtttttgaggattattaaaacaagtaatagtagggtcaataccgacactgttaaaaatactttttactttatattgaacaatttgtaaaattctttgatcatcatcaactagtgcaatattatacataattatctccttttaaatgctcttacttattatacacaatcaataaaatagttgctgaggatactttaaattggcctaaaaaattatattttgaccgaatttgtcaaaatatagcccgaatttgtaaaagtgcggacagggcatttaaattatgataattttaatagcgaggggtgaagattttgtttgaattcttagcagagaagataacgcaagtgttagaaacaaaaaatatcattgtaagagatcgggcaatatataaatatgggatagagacgtggatttctgcattagctagtatcttattattgttggttgtggggatcatctttaattgtatactagaggtaataatatatgaggcggtattctttattttaagaagatttacgggaggctattattgcacaacacattttgaatgcatgagtctgtatattgcaatttttactctttatatggtattaagggaatatttaaaagtatcgattgttatggtttgcatagccatcgcaatatcattaataattattattagtctttcaccagtacaatcgaacgatcaacaattaactgaattggaacaaagaaagtatcacctctatagtaccttgctatccataattgtaggtatttcctgtattgttttaagatttttaaatattccagtttattcaattctaacatattcgttttctttacttgctatcctaatgctaggaggaaaggtagtcaatcgtcgcagttgattgcctctccaaattaatttatttaaatatttataagggttagttattactaacgctttttttgttgttggtattaaagttaaagataatcgtatagtttattagtagtgaaaagagagatgatcaaaatatgtatacaatcttacaaaaaactacgaattatcattgttttttttattcaagcaagatacaatatgaaagtataaaataatgtagggggaaatagtatgtacaagattgtcaaaaaagaagtactaaatgatgtcgttgaactgatggaagttcatgcaccatatgttgctaaaaagtgcgaaccaggccaatttattattttacgcgttggtgaagatggtgaaagaatcccattaacaatcgctgattttgaccgtgaaaaagaaacaattacaatcatttatcagattgttggttattcaactaaagaattagctaaattaaatgaaggtgatgaattgacagattttgttgggccattaggagttccaacagtattacatgaggctaaacatgtaatcggtgtagctggtggggttggtagtgcaccattattcccgcaacttcgtgaattagcaaaccgtggtgttgatgttgatgtaatcattgggggacgtgaagctcaatatgtactattagctgatgaatttaaaaagttctgtaaaaatgtttacattgcaactgatgatggttcattaggaactaaaggttttgttactaatgtattaagtgatttaattgaaaaaggtgaaagctttgatgaagtaattgcgattggaccagtgccaatgatgaaagcagttgtaaatgttactaaacctaaaaatataaaaacttcagtatctttaaatccaattatgatcgatggaacagggatgtgtggatgctgtcgtgtcagtgttgatggaaaaattaaatttgcttgtgttgatggtcctgattttgatggacttcaagttgattttgatgaattaatgctgcgacaaagaatgtttaaggaagaagaacatactgttagtgaaaatgctaatcgtatgtgtaatttaatgggaggtgtcaaataatgccaaacatgtcattaacaaaggtagtaatgccagaacaagaaccagatgtaagaaataagaattttgaagaagtagctttaggatacactaaagaaatggcaatggaagaagctacacggtgtttaaattgtaaacatcagccatgtaaacaagggtgtccagttggcgtaccaattcctgaatttattcaagaagtagctgctggaaatatggaagaagcatacaagatcatcactagcgaaaatgctttaccagctatttgtggtcgtgtttgtccgcaagaaaatcaatgtgaaggtaaatgtgtccgtgggattaaaggtgaagcagttggtattgggcgacttgaaagatttgttgcagattatcatatggctaatggaaaagcccctgaattagatattaagagtaacgggattaaagttgcaatcattggttctggaccagccggaattacttgtgctggagaacttgccaaaaaaggttatgaagtaactgtttttgaagcacttcataaaacaggtggagtattatcttatggtatccctgaattccgtttaccaaaagctttagtccaaaaagaagtagatagtgttgctgctttaggtgttaaatttgaaactaatgttgtagttgggcgttcaattacaattgatgaacttcaggaacaaggatatcaaggtattttcattggtagtggggcaggcttaccacgttttcaaaatattcctggtgaaaacttaaatggtgtatatgcagcaaatgaatttttaacacgggtcaacttaatgaaaggttatgaattccctaatcatccaacaccagttaaaattactgatactgtatgtgtaattggggctggtaacgtttcaatggactgtgctcgtacagcaaaacgtttaggtgcaaaaaatgtttatattgtttatcgccgtagtgataaagaaattccagctcgtgctgaagaagtacatcatgctaaagaagaaggcattatttttaaattattaactaacccagttgaaattcatggtgaagatggatgggtcaaatcaatggaatgtgttgaaatggaacttggagaacctgatgaatcaggaagaagaagaccagttgttaaagaaggatcgaattttgtgattgaaaccggaactgtaattgtttcaatcggacagagtcctaatccgttgattcgtcaaaccacaccaggattagaaactcaaaaatggggtggaatcatcgttgatgaagattctatgaaaacaagtaaagagggcgtatatgctggtggtgacgttgttactggagcagctacagtaattctagcaatgggagctggtaaaacagctgctaaagcaatggatgaatatcttgccaataaataattgaattcctaggtaatccctaggaattttttttaaataaaatggttttcttgttataatggtaaataggaggagcaaaatatggaacaaagtataacatttgtggatgtagaaacacctaattatcaaaataatagtattagttcaattggtgttatcaatgttgatggtgatggtgttgtaacaactaaatattttcttgttgatcccgaggcacattttgaccgtttcaatatagaattaacgggaataaccccagaaatggttgctgaccaaccaaatttcaaagaagtgtggtctgaaatagaaccatattttacaaatagtttagtggttgcccataatgctgtttttgatttaagtgttatcagtgcttgtctgcaacgttatgatctgcctatcttccctattttttatacatgtacttatcgaatcagtcgcgctttaaagattccatccaatagttataaattaaatgatttaagtagttattatcatgtaaccttggataatcatcataatgctttagcggatagtaaagcatgtatggaaatattttattatttattgaaagaaccaaatttggaaactttagatcagtatgttaaatgctttgaaccaaccaaaggaaataaagataataaaaaatatttagaggtactgattggtcttttaaccggaattggatttgataactatttaaataaaaaagaaattagttttttaaataactggttaactaagaatcagcttccttatgagtatgctaatattgtcaaggaattaaaagctgttttgaaaaatgaatatataacacattatcaatatttacatattcttaatgaactccaatatatgaaaagtattaaagctaaaaatatacgttcattatatgagtttatggctattttggaagggatcagttgtgatgaagttattaatgatgatgaaattatggagttaaataagtggatgaaagaaaatgaacaatttaaaggtacttatcccttcaatcgaattttaaataaattagagaagattatcattgataaacaaataagtacaatagttacagatgagttgttatattatatcaaaaatttctttaaaccagagcttgatcaaggtgatttatttgatgtcaagaataaagttatttgtttaaccggtaatttttgttttggggaacgaagtcaattagaaaaacttattgttctaaaacaaggaattataagtaaaagtgtgacaaaaaaagttgattacctggttttaggaagcaaagggtcagctggatataaatatgggaagtatggtgctaaaacaaataaggctttgacaatgaaaagtgaaggtcataagattgaattaattagtgaagccagattaatggaagttttgaaactttctaaataaattgatgtgaggtagatgatgaaagtattggtgatttattgtcatcccagcaataaaagttttacagctaggatgaaagatgagtttattagaggattggaagacggagggcatacttgtcagcttattgatttgtatcaaattaattttgatgaaacatttagtgaagaagaatacttaagagaagccttttatgatcaagccttaaaagtgcctgaggatgttcaagcacatcaaagactaattaatgcaaatgatgcggttgtgtttatttatcctgttttttggaccgaggcaccgggaaaactggtcgggtggtttcaacgcgtttggacttatggttttgcctatgggactgagactaaaatgaaacagttagataaagtactgatgcttgtcacgatgggtggcgacctaagtgaagaaattcgtcagcagcaggttgcagcaatgaaagttgtgatgttaggagatcgaattggtgaacgtgccaaaacgaaggaaatgatcgtgtttgaccgtatgtcccgagattatccggtacgtgaagtaaattattcgaaaaacttaaaacgtgcctacttattaggaaaggaattttagaagaatgtataaagaacgggtcaaagaaaatttagaaaccacaagattacgattaagaaagtttaaattaagtgataaagaagcagtttataaatatggaagagatccgcgaactctaaaatatcttgaatggattggggtgactactcgtgaggaagctagaataagcattgaagaatattatttaagtcgtgcaggaatttatgcaattgctttgaaagaaaatgatttatgtattggagcgattgatattcgtttagatgaagctaatgataaagctagttttgggtacttattggatcccgattactggaatcaaggatatatgagtgaggtattatcacgaattttaaaacactgttttgaagacataagagtaaaccgggttgaagcaattcattatagattaaatccggcctctgggaaagtgatggcaaaatgtggaatgaagcaagaaggaataggaattcaagagctaaaaataaaaggcctttatcatgatgtggtgcattacgcgataactcaagaaatgtggcaaagacgttgatatcacgttattgcaacgcaaagttgacaaaaataattaaagtgcaatggcaagttggtagtaaaaaagtaactgcataattatgatttgggtgaggtgataaagatgagtttaagtgataacttaagagctttaagaaaacaaaaggggtattcacaagaacaattggcagagcgtttaaatgtttctaggcaagctgtttcgaaatgggaaagtgataatggttatccagagatggaatcgttaattattttaagtgacctgtttgaatgtactattgatgatttattgaaaaatgatttgactcaacataatccaacagccaaacaagcatatgataaacattatagtctaatagcaaaggcctatacatttggagttgtttcaatcttgctgggggtatgcgcatatctatttgctgaaatttatttttcggaaaatacaaaatctgagtttattggcgaaattattttcttgttttttgttttaattggggtaattacatttgtttattttggaatgaaagatagtcattttaaaaatagtcattctgaaataacagattattatacggatagtcaaagaagtgaatttaatcaaacatattcattgagtatcgcaactggggtaggagtgattttatttgcagttgttttacagattttaatagagaatttatataatgaaaatctagctaatggtttatttatggtgtttgttactattgcagttggaatttttgtatattttggaacactaaaaagtaagtatgaccaagttgatttaaaagttattaagcaagaaaaaaggaataaaaaagtctcaatatattgtggtatcattatgatgattgttacagcaatttatcttggctgctcatttactacaaacgcctggcatatttcatggattgtttatcctatcgggggaattatttgtggcattgtttggctcctttttgaagcacatgaagaagattagaaaaatgctaatcttttttgttttgcgcggataaatagcaaaatgtaaattattgtatgtagttatattaagagggtcatgttaagattaaagggtaggaggggataattatgagcttaggaaaacggattcagtcgtatcgaaaacaaaaaggattatcacaagagcagctggcatcaagattaaatatttccagacaagccctatcaaaatgggaatctgatataaatgtccccaatattgataagattatggatgtagcaaaagctctagaaatcacgcttaatgaattacttggtttagaagaagattcaaatgatgagtatgctaagttggaaagtattttaaatcaagtggtgttaactcaaaataatgagattataagaaacaagaaatatttaaaaatgggtttggtaattgggacgggaatatttataattcttgctcttgttatgtggagtgttttaaatgatattaaaggaattaaaagcacgattggaaataataatgcaggtttaagtaatcagatcaatataatcaataaccaattatcatcattagaaaattctctttttgatcagcttcaagaacaattacaagcccaaggttctttactaagctcttttgagcttcaaattgaggatattgattttaaaacacagacaatgaaagtcaaaattgatctagttgttaagaattatgaggatactagtagtgtggtagttgttttagattatgagcattatgatgatcggtcatatctattaacattaagtgatggacattttaagacaagtgaagatttacctattgataatattttaaatgctgccgtgacaattggaacagatagtaaacaagcacagttattaaaaaatgttgcagattatatattgcctgaattgaaacttaattatggtgaagtttatgaaataatctatcagcaggattcgttaaacattacgttaaacccagatgatactgtaaatttgaatgagagtggtatattgtcaaaatataaaaaagataataaattagtaaaattcgatggattttattatttaaatgatcagaagcatactgttaaagttacaacagataagcaaagaaatattcttttttcaattcctgctaatgactttaagaatggtgataaactaaaaatagtaattaatttggtcgataaaacggggatcacttctcaaattgaaaagaattttattgtagcaattatagatgattcagttagtctgtatgaagaataaagcactagtattatattagtgctttttatcatgataaaactaaataacatttagatattatagtgataataaagttagaaatttctaaaacaattattatcatgataaaaaatactgttattttgtttagaattcgtgtataattgccatgaaggagtgataactatgtataaatatttggaaccatatgcagcaatgatagaatttttagggaaggctttaggcgataacgttgaaattgcgttacatgatttaacttcaaaagagcaagaaatcgttgcaattgctaataaccataactcaggaagagaagttggggctaaattatcaaatttatcattacattatttagaagaaaaacagtatttagataatgattatgtaatgaattacaagacaactggaccagatggaaaattaatgcgttcagcaacttattttattaaagagcctggtaaggaaatgccagtaggtatgctttgtatcaatgtaaatatttctgatttagaatatttaacatcgacgattaaaaaaatcttaggtattaaagatgaaaaagatattgagtttaagatggataatccagttgaaattttatcttcaccgttagatgaaatgattgatctttatattaaagaatgtttagagaaaatgggtttcccaagttatttcttagcagaacgtttgaatgttgatgaaaagatcaaggttgttaaatacttacaagaaaaaggtacttttaaagtaaaaggagctattgttttagtagctgaaaaattggcagtttctgaacctacagtatatcgttatttaaaaaagatggaaaaataggagagtaaaatgaaagaattagtatatgtaagtggtcataaaaaccctgataccgattcaatctgttcggcaattggatatgcttatttattaaaagcaattgaccgttataatgccgtaccagtaagattgggtgaggtaagtcgggagactgagtatgttttaaaaagatttaatttagaaataccaactttattaaaaactgttaagcaaaaagtagaagatttaaactatgataaagtaactgtattttcaaaagaattaacattaaagactgcatggtctttaatgaaacaacagaacttaaaatcagcaccaatcttagatgatcatgggcaattactaggattattatcaacttctaatattgttgaagggtatatggaaaaatgggatagtagtttattaaaagatgcgcatacaccaattgaaaatgtaattgatacattagaggcatcagtaatttatttaaaccataatttaaaaacaatcgaaggtgatcttcatattgcagcaatgcgtggtgaagaagctagtaaacgtgttagaccaggagatattgtaattattggtggtgatcgtgatgatgctgttaattcaatgattgatgctgaggtttcattgattattttaactgggtctttgggtgttgaagctgaagtactaaataaattaaaagaaaagggaatcagtgttatttcaacttcttttaatacatatttaacttcacaacaaattattcaggcaattccggtagaatatatcatgcaaaagggagatttaaaattattctcaacagatgatacattagatcatgtaaaagaggtcatgagtgaaacaagatatcgtagttatccagttcttgatctaaataatcgttgcgttggaagtatttctcgttttgctttattaaaaggattaagaaagaaagttattttagttgatcataatgagcgtggtcaatcaattcctggaattgaagaagctgatattttagaaattgttgaccatcatcgtgttgccgatattcaaacgatcggaccattattatttaggggtgaaccattaggatcaacggcaacgatcgtaacaaagatttttgatgaaaatgatgtagaaattcctcaatctattgctggggctttattaggagcaattatttcagatacattattattcaaatcaccaacatgtacacctgtagacactaaggctgctcgtaaattagctaagatcgctggggttgatattgaagaatttgctatggagatgtttaaagcaggaacttcattagttggtaaaacagttgaagaaatctttaatcaagatttcaaaaaattcccatttgaacaaggaactgttggtgttggacaagttaattcaatggatattgaaggatttatgccatataaagcagatatgcttgactatatggacaaatttgcagaagacaaccgtttagattttactttattattattaacagatattattaatgctaatagtgaaatctttgttgctgggcctaaaccatatttggttgaagaagcatttaatattaaattaaatgatcatcaagcgacattaaaaggggtaatttctcgaaaaaaacaagttgttccagcaatcacagcagtaatgagtaaataagatgagattagataaatttttgaaagtatcgagaattattaagcgtcgtactttatcaaaggaaattagtgaaagttcacgggtaaaagttaatggtaaagtcgctaaaccaagcacaaaacttaaagttggtgatgaaatcgaaattgaatttggacgtagtcgtctgactgttaaggttaaagaacttcgcgaacatgtcttaaaagaagatagtacgatgttatatgaaataattaatgaagaacgaattgagcgagatttaaattagaaaccattattggtttcttttttataaaatgatatatttttattatattggttgacttttactcattagaaaagttatcataatatatggcgataggattgttactattagattaggcaagaccaaattggagaaatacgaataacgtgtagctatatgcagttgttttcgtataaatttcaatttggtcttttatattttatttaataggattaattatattatcgctgttctatacggaaaaggaggataagatgaaaggattaaaaaaattattttcagctatgctggtgctgacaatgctttttgggacgattgcaaatgttggtatggcaaagatttatgcagctgaagaaggaatgaagcgggtgttttctattgatgccgggagaaaatacttttcagaagaacaacttttacaaattattgataaagcttatttaaatggttacacagatgttcaaattttgttagggaatgatgcattacgttttttcctagatgatatgtcaattactgttgatggtaagacatatgcaagtgaagcggtgaaaaaagcaattacagcaggaaatgatcattattataaagatccaaacggtaatgctttaaatgagactgaaatgaatcggattgttgcttatgctaaagaaagaggattacacattattccagttattaatagtcctggtcatatggattctattttagttgcaatggaagaattagggatgaaaaatgtacgttatagttataatggaaaagaatcagaacgtacagttaatatcgaaagtgatgaagctattgcattcactaaagagttagtaaaaaaatatgttacctattttgcaaatgcaaatgtatctgaaattttcaattttggtgctgatgaatatgccaatgatgtgttcagtaatccaggatggggagaattacaaaaaattggtttatatgatgaatttgttgtttatgctaacgatttagcaaaaatcattaaagatgcaggaatgaagccaatgtgttttaatgatggtatctactataataaaaaagatagttctggaacatttgatcaagatattatcatttcatactggactgctggctggtggggattcaatgtcgctaaagctgaatatcttgtaaataaaggtcataagatcttaaatactaatgatgcatggtattgggtattaggaaatattgataccggaggatataactacaatagtactgtaaacaatattaacaataaaaaatttactgatgtaacaggtgcttcaaatgaattaccaattattggaagtatgcaatgtgtatggtgcgatactcctagcaaagagcatgatatggatagaattataaagttaatggatctttattcacaaaaacatacagattatttgattcgtcctgcagattttacaaaagttgatgaagcaattgctaagattcctgaagatctaagcatttatacaactgagtcagtagaaaagcttaatacagcaattgataatattgatcgtagcatccgagttacagaacaaagtattgttgatgggtatgcagccgctattgaacaggcaattatcgatctaacattaaaagatgcagattattcaaaagttgacgaagcaattgcaaaagctgaggctttaaataaagatgagtatacagatttttcaaaagttgatgctgctgttaaagctgttaaacggggcttagatatcacgaaacaaaaagatgttgatgcgatggcagctgctattaatgaggctcttgcggcattagaaaagaaagaggcagtaacaccagataaaccaaattcagaaaaagtagattcaccaaaaacaggtgatacaacaaatacaatggtttggttaagttttgcggcaatgagtattttagctagcacattagttttaaaaaaacgtaaaacatattaatagacgataaaaataaatagttatagtcattgattcataataagaagtctaattttattaaagttaggcttcttttatattgcagttaaatattagcagtgcacaaagaaagcctttacatttataatgatatagtataaactttatttataccaatgaattataatcattctattaaatggagggaactatgaagagagtaattagagaaattaaaaaagctggttcgattgcaattattatagcaatgctgttaagtttcgtaccgacaggaatttttgccttaaatgagtccaattataaagaaccattggtatttgcggattttgaaggtaatgattcaaatgttgacggatcaaacaatgcggcggttagttttattgagggatttgcaacaggaacgggaaaattagtagctaaactagagcttgccaatagtggtgatcctagtattagtgaacgtagtttggtaataacaaaagagacatcagtcgatgtttcaaactacaagtatttaactttttggatcaaagacaatggaacgaatagtgctaaagtccatttaattgatgccagtggtaatgctactagtggcaactggacagggaatgtaacggcgggtaaatggagtcaattatctgtatctttagatcaatttaaaaatattgatttaagtaagattactggtgttgttatcggtgaatggaataaaggtagttatttaattgatgatgttcaatttacagatgtcttggctaaagatttaaaattaagtgcaagtaaaaacacaggtacatataatgatagttttgaagttacccttacggctggagaaggacaatcaatctattatacagttgatggaagtcagccaactattagcagtactaaatatagcaatagtcttacaatcgatgagtctatgactttaaaggcaattgtagtcgataatcaaaatattagtgaagtttatgaatttgattatattattgatcatcaagataatcggatttatacacctgtagttgttcaaacatttgaagaccaaaataattttagtgcagctaatggggcatcgggaacaattgttacaaatgaaaaacatagtggtgaacaaagtctaaaatatgtaaaaactaagagtgaagccgctagtactagtaaaggaagtataaaaattgattttaatcatgctgttaatgcggcagatttaaaatatttaattttctatatcaaagatacccaaggaagtaacacccttcaagtatcattgattgatactgatggaaaggagtcagattttggatggcgaagtccaagtacaacaaaggataaatgggtccaatattgtatcaaagtatctgattttaataagatcgataaaactaaaatagcgggaattagaattggtgaatggaacgcaggaacatattatctagatgatatttattttgataattatttatattcgggattgccaagtttagtaccgactaaaccggaagccaatataagcgatggttatatttttaaagataggttagcagtaactttaaaaaatgataacaatgcaccaatgtattatacaatggatggaagtaccccaaatgttgatagtactaaatatagcggtgaaatagaattatctaaaacaacaacactcaaaacagttagttttgataatggaaaatatagtgaagtagtggaattagcatatataaaagatacaaatatccctagtgatgttaaagctgataaagtagcaggaaagtatacaaaaccaattaaagtaacattaagtaatgaagataatcttgctatttattatacgattgatgggtcgactccttcaaaaacaagttctaaatatacaacgccaatttctataggtgaaactaccgtgcttaaggcggtaacttatcaaggtgatagtgctggaaatgtaatgacatttaaatatcaatacccaacagtgccatccgaagttacagcgagcattccggaaactaaatttactagtagtaagacggttgaattaattagtgatattgatgcgaatatttattatacaacagatggcagtgttccaagtctgacttcatcacgctatgatcagcctcttacaattagtaaatcaatgacagttaaagcaattgctgaacgagatggtaaaacaagtgcagtaacaacattagattatattattgcgccagtagctgttcaagctgacaaaccagcgggaacttatgatggttcagtagtggtggaatttagagttccaaataatgatcaagtagaaatttattatacaacagatggcagcgttccaacagtggcatcaaatcattatactcaaccgctacgggttagtgaaaatacaacttttactgttggagcaacatataaaaatagtaatgatattggtgtggttacaaatcacacatatataattaatccgattactgaagctaaggccccagtgattacgccaggtagtggtacttatggtcaaaggcagttagtgtcaatgagcagcgatactcaggatagtaagatttattatacagtggatggctcaataccttctagggacagtatggagtttaaggaaccgttttatgttaaacaagatactgtggtcaaagcaattacagtaacaaaaaatggtattagtgagataactgtaaatgaaattaaagttaatcaagaagcttcaaatttcttaaaaacagatggaaaagtaattcgtaataattatggtgctggaaaaaaaattcaattaaaaggaactaatgttggtggctggctcgttatggaagaatggcaatgtccaactagcgcaccagatcaaaaaacaatgctggaaacatttacaaaacgttttggtgaagcaaaagcttgggagttaattaatacttatcaagataattggtttacagaagctgattttataactttaaaagaagaaggagtaaattgtcttagattaccaatcacttattttgagatggctaatttagacggaacgcttaaagagactgcatttgatcgtttagattggtttatagaagaagcagctaaacatggaatctatacattgattgatatgcatggtgcatttggctcacaaaatggtaaagatcattccggtgatattacttatcctgatcaaggtgatttttttggaaaagaagaaaatattcaaaaaacaattaaattgtgggaagcaattgcagctcgttacaatggaaatgagtgggttgctggttatgatttattaaatgaaccaggtggagcattaggtactgaacagtttgaagtgtatgatcgtatttataaggcagtaagagcaattgatcaagatcatatcattcaaattcaagcaatttgggaaccaacgcacctaccagctccaacattatatggctgggaaaatgttgtttatcaatatcatttctatggatgggatgatattaataatttagaatatcaaaaagcttttattaatagtaaaataaaatatgtaaatgaagatactaattataatgtaccggtttttgttggtgagttcactttctttacaaatatggatagttgggaatatggtttaagtgtttttgatgaacaaggctggtcatatacaagttggacatataaggttgctggagcaaatagcagctggggaatgtacacaatgcctaaaaatgacagtaccaatgtgaatattaatactgatgattttgaaacagttaaagcaaaatggtcaaattttgactttacgagaaatactagtattgctgatgtattaagtaaacattttaaaatagtaagtagtgatttgattgctccggtaatagaaggtaatgatgcggctgttatggttggtgtaaaagcaacagtaagtgaaatcctcgacttatttattaaggatgatcaagatggtgtgattgatattgcgaaagcagatattacaactgattttgattgtagtaaagcaggggtatatacagtaacagtagaagctagtgataaagcaggtaatataagtgaagcagcttttacaattacggttaaagaagaaacagttattgatcctgatgtggttgaaaaaccagattcatcaaaatcagaagtttcagtaaataagccggtcaaaacaggggataatgaaaatattattggtgatttaatgattttaggattatcaatgatagcaggtgttatcttattgaaaagaagaaaagaaatttaattagaggtagtaacgagataaattctcgttactatttttgatataatgcatggttatgtatttaaagaaacgttataataaatatatggcacaatgaggaggcaatttatgcgaatattaaaacgaatatcattactattattatcattagtaatgataatatctttgagtggctgtacagcagatactaacaacaaagatgaacgagcgagttttgatcgatttattgaaagacaatttattgaaacaatggaaagtgattatacaactgcgcatgtttttttagaacatcctgagaattttgatgttgatatttcaaagttaacagtaaatctaggggtgcgattagatgaagaaagcatgagaaatcaggagaagaaagatgctgattcgtgggcggagtttaagaagttcgagcgttcaaaactaactaaagaacagcaggatacttatgatatttatgaatttcaaaataatctagctcgtgaaatgagcgatgataaatttgattattatcaacaattgtttgagagtatttctggaatacattatcagattcctactatgttagctgactggtcgcttagaaatgaacaagacgtaaaggatattattagtttagtgaatgatgtcttaccatatttacaaggagctattgactataccaaagaacaggcaaaacgtgatttgctaatgatagatgttgatgcggttagagagtattgtgataatgtgattaaaagtggtgaaaatagtttaattttatctgatataaataaaaatatagatactttaaatttagaagagagtgttggcaatgcatataaagagcaattaaaaacagcttttaattcttcttttattcctgcttatcaagctgttaaagatttaatggatgaagtaagtctaaccggcaataatgaagaaggattagtcaagtttaaaaatggaaaagaatattatgaactgttattgcaaaatgccgttggttctgataaatcagtaatggaaataaaagaattaatggaagacagtttagacaaacatatttccaagcttcaggagaatgtgattaaaaatgctagtgttagagaatttcttactagtggtggtgaaataccaactacaaagtatactagttatgatgaaattctagatgatattagtgctcaactgtttgaagattttcctagtgttagtagtttatcttataatattagggatattaatgaagaaatagcatcttcttctggcgtcgcagcatattttaatattccgcctttggatggtaacggtataaaacaattacgggtcaatccatcgactggtgaggtatcagatcttgatactttttcaacagtagcccatgaaggttatccgggacatatgtatcagtatgcatatatgtatgaaaatattcaatccccatatcaaaaggctttagctaattcaagtgcttatacagaaggatatgcggtatatgcccaattttatgcatataaatatctaacaggcattgataaaaatgtattagaagcgcttaaggaaaatgaattagcaagttatgatataatgattctttgtgatattggaattcattatgagggatggtcacttgatgattttagtgactttatctctgaaaagggtattaatctagaggaggacagtttaaaaactcaatataaacaattgcaagctaatccggctgcgtttgagccatattatgttggttatgaagaatttatgcttttaaaagaaacagctcaaaataaattgggtgataagttcaatgataagaaatttcatgaggcaattttaaagagtggaaatgcaccttttacagttgttgaaagaaatgtagcagcttatattaagagtgctaaataaaagattttatatgaatctaaaaaacagttagagtattatgattgtaagttggaaaaaattggtatactatatgtatcataagaaaaggagatgtatatatgtacggaaaacttgcttgggaaaagtataatgatgaacaaattaatgatattatgacttttaatgaaggttataaaaattatattaccaaaggtaaaacagaacggttatgtgtcagtgaaactgttaaactggcaatggcacatggatataaagagttaaatgaggtagatattttaaaaccgggtgataaagtatatgttactaatatgaaaaaaaatattgctttatttgttattgggaaaaaaccgctagaagatggaatgcgaatcttaggtgctcatattgattcaccaagaatggatcttaaacaaaaccctttatatgaaagtgaagggtttgcaatgcttgatacacactattatggtggggtaaaaaaatatcaatgggtaactattccactgtcaatggtaggtgttgtagtaaaaaaagatggtactgtgataaatgtaaatattggtgaagatgaaaatgatccagtcgttggaattagtgacctgttagttcatttatctgctgatcaattgaaaaaagatggtgcgaaagtaattgaaggagaagacctagatgttacttttggaagtattcctttaaaggatcatgaaaaagatgctgtaaaggcaaatgttttaaaaattctaaaagataaatatgattttgatgaagaagattttttaagtgcggaaattgaaatcgtacctagtgggaaagctcgtgactatggaatagatcgtagtatggttgctggttatgggcatgacgatcgtgtttgtgcttatacatcattaatggctattttagatatggaaatgcctgattatacaagctgctgtattttagtagataaagaagaaataggaagtgttggagcaactggggcacagtctttattctttgaaaatacggttagcgaattattgttgaaacaaggaacagatagtttcgttaaaacaagaaaagccatggctaattcaaaaatgttatcaagtgatgttagcgctggagttgatccattgtatttaagtgttaacgataagaaaaatgctgcatatttaggtaagggaatagtttttaataaatatactggagctcgtggtaaaagtggttctaatgatgctaatcctgaatatatggcagaaattagaaaaatcttagatgatgataatatttattaccaaacagcagaattaggtaaagttgatcaaggtggtgggggaacaatcgcttatatccttggaaattataatatgaatgtaatagatgcaggagtagcagtgttaaatatgcatgcaccaatggaaattgttagtaaagtggatgtatatgaagcttatctagcatatcgcacattcttgaaacaaatttaagatatcttcggatatcttttatttttggatttgaactaaagatgataaaccataagataattgcagataacagtgataagttatagaaagttgcccgtttattaaaccattttcttgcttagaaaaagacttgcaggaattgtaattttagttataatgttttaggcttggaggtggaatggatgaaaaatatgactcagggtaatcccctaaaattgattttgatgttttctatgccgctgatgttaggaaatattttacaagagttttatacaatcgtagatacgattattgttgggcaatttttaggggtaaaagctttagctagtatgggggctgcaggctggatccaatggatgctccttagtgttgttatggggttcgcacagggcttctcgattaaagtcgctaatttatatggtgcaaataaccatgagggaatttctaaaacaattggtaatattgttattgcttgtcttgtaattgcactacttttaacgattagtggtgagctgataatcattccaattctcaaactcttacaaacacctaatgatattattcaaggggcaattgcttatttacgagtgatggctggtggtgtgacaattactttgatgtataatttgctatcatgtgttctacgggcttttgggaatagtaaaacaccattacttgcaatggtaattgcagcttcattaaatgtggggctggatctgttatttgtctgtgtttttcatttgggaatagctggagctgcgatcgcaacaatattagctcagctatttgccagcttattttgtttactggttttatataaacaaagcatttttagcttaaagtctgaacactttaaaattcagcggcatttaatttttgaattagtaaaattagggcttcctttagccttgcaaaacggaattatttcaattggtgggatgatcgttcaatttgtggtgaatggttatggagttatttttgtagccggctttactgcaacgaataaattatatggtttacttgaaacagctgctatttcttttggttatgctttaactacttataatgcgcaaaactatggagctcttgaatatcaacgggttcgagaaggtgttaatgcttcagcattaatatcacttgttacttcattaataatcgctcttattatgattgtttttggccgaaatattttaactttatttgtatcaggaagtcaaaatgaaattaatgcggttcttgaggttgcttatcactacttgtttattatggcggtctgcctaccgatcttatatatattacatacttatcgaaatgctttacagggattgggaaatacagttattccaatgttttctggaattgtagaattattgatgcgtgtaggaatagcacttttcttaccactgtttatggggcaggaaggaatttattatgcagaaattgttgcttggactggagctgctttattactgtatattagctataaacggactaaactgggggattgatgaatccggttttagttatcaaaaatgttgataaaaagaactatttttaaactggagaagtcatgctataatgggattaaggatggtgaaaattgtggtaaaagttgaagtggttccgtataatgaagattggcctcgtaagtatgcgctggaagcaaatgtgattcgcaatatcgttttagatgaattaattacaattacacatgttggttcaactgcagttcctggattagttgctaaaccgatcattgatattttgatcatcgttgaagacataaataaattagatcagttagatcctttatttaaaaaagaagactatgaatgttgtggggaggacgggatttcaggtcgacgtttttattataaaagcgatggttcaatccatgttcatgcatttgatgaaagaagtcatgataaaattgaattgctgatttctttttatgattatttaaaagataatcctgatattgctagggagtatggtgaattgaagctttcattagctaaaaaatatcctgataatatcaaaaaatataaaaagggtaaagaagcttttacaaaagaaatacaaaccagagcgttaaaatggtatcgtcataaagatgtcgaacagatataaatagttcttaattccactaatcagcatattaattagtggaggtaataatatggataataataacagtattcgttttgaacacacaccttatcataatgtttatttaaaagaccgtaaaaatattgaattaacaggtgtgaaaaacattgaaagttttgattcgctagaatttttaattgaaacatcattaggttttttaaatattacggggaccgaattatcgttgacaaggttagaccaagaaaaatgtgaggttagtattaaaggcaacattgatgctatttcctatgtttcaaataaaaagaatcaaaaaggaaaagacagtgtttttaataaactgcttaaataatggacttagtaaaacaaattcaaggaattagttattcactggtttttggtttcactttcacttttatttacagtctcatcaatcgtttgttttataaataccacaaacgcatttttcgactcattttacagattgttattggtattatttttgggtatctctattatcttggtctgttagttattaataatggggtcgttcgaatatattttattattagtatggtaattggatatgttctctatcttaattattatagctattatatgttttttttgattgaaataattgtaagtatgttaaaatatcttttaagaccgataatattcatttttaggaaaataagtggtataataaaacgcatgaagagggtggtaaaatggctaaaagaaaagtttataaaaccgtcaaaggatttgcctacatgattataggctgcggcttgatgttgactttatttaatagcgccataactgtcttccagcgtcaagatgaaattgcggttttggaaaaggaaaagaaagcagtagaaaaagaaaaaaaagctttagaaaatgagatcagtttattgaatgatgatgattacgtagctcgttacgcacgtgaaaattatgttttcacgcgtgaaggtgaacaagtagcgatcattccgggcgtagaataaataagcactttgtgcttatttttattatttattggaggtaatttatgtttatagaagagaatatgtatatgagatcattgcgaagaaagcgtaaaatcacaatttatgtacctgatgattatgaaactagtaataagcgttatccggtcttgtacataaatgatggtcaaaatgctttttttgatgagacttcatatatgaaaattagttggggattttatgattatgttcaagcgcagaacttagatgttatcatggtggcgattccctgcaataaccgtttaaataaacgtgaagatgagtatggaccatggcgaattggtaaagaaattttaatgatggaatatggtgatgatagtttagaaattggtggtgaaggggacaagtatttacgctttattattaagcagttaaaaccttatattgatactcatttccctacgattgttgaagatagtgcgatggttggtagttcaatgggtggaatcattacaacttatgcaggattaaaatatccccatatttttaaaaagacggcatcgctatctagtgcatattggttttatatggatgaacttattgatttgatccatcggagtgatttaagtgctacgcaatgtttttatcttgatctaggtggtaatgaaggtaatggtgatgaagagatgagccgtatctactatgagagtaatgagacaatatacaatgagcttattaagaaaagtaatcggatcgaaggacggttctttgaagaagctggtcacaatgagtatgaatggcgtcaacgagtgccgatttttatggacctattttacaaataagaaaataattcgaggttttaataatttatgctattattaaagtattggaggatattttatgtataaattaatgttgtcagatttagatgagactttattggtaaagcatcacgtaccagaatttaatgttgaagcaatcaaagctgctcgtaaaaaaggattaaaatttgttccagctacagggcgggcttataatatgattccggagattttaaaggaaatcgatgcatatgatcaagaaggtgaatattcaatttgttttaatggggcattgattgtagaaaataaaaatgatcgtatcttaaattttgagggaatatcgtttgaaacaactaaaatgctttttgaaaaggctcgagattttgatgtttgtgtacttattttcacaattgatatgtgttatatttataatgctgatcctgatgaggtacagcgtaaaacggatcaaaaggcaccgttcgttgttattgatgaatacaatatggatgacttgaaagatgaaaagatagcaaagattttgtatgaaaaaagagatatgccgtatttaaagtcgattgaagtggaagtcagtgaaatgattgaaggaaaagcttgtgctagttattcttcagggcgttatttagaatttaatgcgattggaattgataaaggttttgggttgcgctggctagctaattatttaggcatcgatattaatgaaacaattgcaattggtgataattataatgatgttgaaatgattaaagcggctaagttaggggtatgtgtaacatgtgcgactgatgacattaaggaattagcgcagtatgtcactgaagttgattatgatcaaggagcagtaaaagaagtaatagaaaaatttgtattggaggcagaataatgggatataaactaatagcatgtgatttagatgaaaccttattaaatgatgagcatttggttggagcgaaaaatgtcgcagcaatcaaaagagcccgagaagaatatggcgtgaaatttgttccagctacaggacgaggatttatgcaaattcaaccagagttaaaagaattacaattatatgaccttgagggtgaatatgtaatttcttttaatggtggagctttaacagaaaataaaaataatcgtattattgagttcaaaggtttagagtttagtaagatgaaagaaatttttgaagcaggattaaattttgatgtttgtatccatgtttatacgcctgataatttatatgtgtttaatttaagtgaatcggaacgccaaagaattaaaaatcaaaagttagaagcggtatatcctgaagttaatagtgttgattttttaaaggatacaccaatttctaagattttgtatcaaaatgttgatgttccttatttaatgagtttagaagaggggttaaaaccaattactgatggacattgtgcggttagttattcatcaaatcgttacatggaattcaatgctcttggggtggataaaggacaaggattgattgatttagcaaataaattaggcatcgctattgaagaaacgattgctgttggtgataattataatgatatggcaatgttaaaagtggcgggcttatcagtcgctgctaacaatgctgtagatgatgttaaagctgcatgtgattatacaacaaatgctaacaacaacgaaggtgttgtggcagaattgattgagaaatttatttttaatgagatttaaagatattgttgaaattgagtttcaacaagattattataagcagctacatcagtttgttgaaaatgaatatttacataaaacgatttttcccccaaaagaaaatatttttagagctttaaatctttgtgattatgaaaatgttaaagtagttattttaggacaagacccttatcatgaacttcatcaggcaaatggattggcattcagtgtttatccgggggttcggattcccccaagtttggttaatatttataaagagttacaagatgatttaggaacaatgattcctaatcatggagatctcacaaaatgggctaagcaaggagtcttgttgcttaataatgtgttaacagttgaagaagggcgggctaatagtcattctggtaaaggttgggaaacttttactttaaatattgttaaagctttaaataaacgccaaaagccgctagtatttattttatggggaaataatgcccgtgctaaaaaacaatatatcgacacttcacgtcatttggttttagagagtgcgcacccttctccactatcagcacatcggggattctttggttcacatccttttagtaaggcaaatgaatttttgattaggaatggaatgccaatgattgattggcaaattgataatatttaaaggttggtttatcagtaattatactgataaaggcaacctttttcttaagttttcttaatcgttataggattcattaaaaaaatatattaaatacgttataattaaaagtgaaaaaaggaggggactaaaatgaatagtggtattgggattatttgggcaccggttagtgctggaacattggttatttggggacttggaatatttgttgcagttgtaggaatggtgtggtttgttaaacggctcaaaaaaaagattcaattataagataaaagagggatttcgtaaaagaagtccttttattttgaatccttatttgtcattatagataaattgtattagaataagttaaattacttgcagaggagaaaataatgtttaatgatattaaaagtgcgctagtgtatatagagtcaaagcgaactaagcggaccttggaacagtttaaagagacaattaaaaaatatggctttaacatttaccaaaaaaatattattcatatagctggaactaatggtaaaggttcaacaactaattttattaaagatattatggttgaacatgggtatcgtgtgggaacatttacatcaccatatcttatttgtcataatgatcgtatttgtattaatggggaaatgataagtgatgaacgactgctgatgattattaacagtcttgttgagattattgaaagcgaacaattatcgatgtttgaaattgatattttgatcatgttgcgttattttgatgaagaagaactagattatcgaattattgaaacaggaatcgggggattaaatgataaaactaatgtaattgatagtgtttgcagtgtgataactaatatcggttatgatcatcagtttatgttaggtgatactttagcacaaatagctcatcataaagctggaatcattaaacctgaacaaacttgttttactagcgaaataaataatgatttgattgatatttttaaagctgcagctgaaattaaaaatagtcaagtagttagtgtggagatagattgtgattatcgatatccttatcattttagctgtttaggttatgattaccagttaagtaattgtggtagttatcaggttgctaatgcgacattggcgattaatgtatgtgactatttgattgagttagatcattccttagtacaacgagctttagatggatttagctggccaggccgatttgaaaagtttggaaagatttatttagatggggcacataatatcgatggaatcaaggcactaattaagacattacatgatcaacaaataaaaaaggcattagttatcttcagtgctttgggggataaagatattgaacaaatggaagctttattaagtgaatatccattgattcaagcaacatttgcagatgaacggctacaattagagggaattgattttaaagaagcaattaaaaataatattgatctatatgatcatttaattattacaggctcgttacattttattagcacggtccgtaaatatcttcaaaataatttaattgaaaagcaggtatgattcaaatttacctgcctttttgtttgtcaacaataatagttacgatgacagtgattgcgaaggttgagatagcaccatataccgcctagcatcaaaactaagaagaaaaaactcccagcgagaattaggctaataacacttgtataagcataggcttcaatgataattgctaatagagaaattaggattaagccactactgccgagcgtagctagattaccgcaacaagtataagcgttatttggcggggttaaagcttcgctgattaagatactgacgagtccaaagataccgaggaatgcattgatgataaagaaaatctgattgatataaattgaactaccaaatattaaaaatatagcaattgcaacaataagtgcaaaactaatgattaataattgtttttttagacaattcattatttccctcctttctaatataacttatgcattcttgaaagagagataagatgaaaaagcatagaaaaagaagataaaatcttcttagtcaaaattacgattataccaagttagaaaaatatagacggtccaaatttttcgcgcattattgtgaattccttgataatgttcatcaagaagataatttaaatagtcacaattaaaatatttttgagcacttttactgttgaagagttctttaataggctgataatattgttcttctttgatccattcatttaagggaacagggaaaccaagtttttttcgttcactattttgaagaggaagggattttgctgccatttttcgaaaaatatacttagttgcttttttgttgacccgcaaatttgttggtaaaatggaactaatagcccatacttctttatctagatagggtactcgcacttcaagtgaattagccatggaaatatgatcagctttacgcaaaatatcgccccgtagccaaaagtttaaatcaatatactgcattttagtgatatcatctttttttgcaacatcacggtagtaagcatttgttaaaacttgtggtgggtatataggccattgtggtttaattagtttttttagctcatggttttgaaaaataaatgcatttccaataaatcgttcttctatcttttgtccagctcggattaaatattgtttacctttaaattcataattggtctttattaaaatatttttaagacctttacgaagaaagaaaggaattattttcgttggggctagggtcaggggggtttgatagatattataacctccgaataattcatcagcgccttctcctgataatactacttttacatgttgactagccaatttagttaaatgatagagtgggatgatcgaaggatcggcaactggttcatcaagaatatttaaaatagtagggatagtatgccaaaattcatctttggtaattactttttgatagttttcaatatctaaatattgagataattctcgggctaaagggagttcgttacaacgatgatcttcaaagccgacactaaaagttttttttacttggctgtttgctgctaagtaagaagaatcgatacctccagatagaaaagaacccatttcaacatctgctaggcgatggtggctgattgaatctttcagcgttgattcaagcatattgagggcatcggtttcttttaaattatcatcaagattataattgaatttaaagtaatgggttagttttagattatcagtaaattcaagataatgagctggtaagagttgaaagatgcctcggtaaaatgtttctgttaaaggattatattgaaaagctaaatagcttgaaaggcactgctcgttaaattttttttcaactccaggatattcaaacaatgctttgatctctgaagcaaaaactaattcatttttaacaattgtataaaataatggtttaattccaaaaatatcgcgcgctataaaaagcgccttagtatgtatgttgtagatggcaaaagcaaacattcctcgtaaatgattaacaatatcattaccgtattcttcgtatccgtggatgattacttcgctatcgctattagtcgtgaaagtatgacctaaagagatgagttttgctcgtaagacttgatagttgtatatttcaccattaaaaacgagaatcaatgatttatcttcattaaataaaggctggttaccgctgtctaaatcaatgatacttaaacgtcgcatccctaatgtgattttactatcttgatagtatccttgatcatctggtccgcgatgactaattttttgtaacatattttcaataacgctttgattgttggaaacgttattagtatatccaataattccgcacatataaatacctccatggtggcattatatgctttaaataatagaaatgggtaaaagttaagctttattaaataatgctaagatagataagaaaaaattaagaataaataagaatcaataaggacttagtccttattgatatggatattgataattaagcgcttcatcaaattcagcccattcaagatagactaattgtaataagtagcgtttgccggttttgggatcgtgaagaataaaatgatctcgtcccgcctgttcaataatacctttaaagattctgtcccgccattcattgctgccggtatacgtaaagtaaaaggtacctaatttcccaacgttgatccgtaaaatattttcaacatatgcttgatcaataactggtgctggagttactgaaggtgtagaaggtgttcctggggtttggttaggggtaggggccggagctggcgttggggtagtatcaggggtttcagctggagctggatcctgccgtactaaataagggtttaagtcattaaaataatccataatcgatctcctcgtataattttttataaatcacaatttaattttaagcctgggttataaaaacagtgttgtttaaagcgaccggataaattgccatagaatttttctgggcaagcgacattggtaccgggatttttaaaccatagggcattagttgccggttcatttcgatagccgttaatacagcgtaatgcaatttgccgaagcagttcgttgactggttcgttaaagagtggggttccgaccccggaaaaagcattcttttggtagactacttcagtgatggttcgggtgtttcgaaaaacatcacagtttgcaacaacgcgattgataactacattaccaactaatagcataccttgttctccttcacctaaagcttcagatttaataagccgcgctagtaaatcgacttcttcggttgagtatttaattcgtgccaaattatcaccccgttataatatatgcagttatttataaaaaatgatagttgtttgaatttagggaaaattgcggggataaaaattatgatatcattttattaaaaaaataaatgagagtataatatatgacaagatacaataattatatttcgtataattaatctcgaatttatttctaatttatggtagaattaaattataggtaaagcgcttacattagacaaggaggtatttaaaaatgggaagagagattgtcgcaatgattttagctggtggacgtggaacacgtctagaagccctaacagctaaagtagctaaaccagcagtacactttggaggtaaatatcgtattattgactttcctttaagtaactgcgctaattcggggattgatattgttggggtgcttacgcaatatgaatctgtattgttaggtacttatgttggtgccggaactaaatggggacttgatggaaaacaatcactagctgcaattttaccggctcgtgaacgtggtgaagtaggagcaacctggtatgctggaacggctgatgctatttatcaaaacattagctttatcgatcaatatgatccagaatatgttttgattttatctggggaccatatttataaaatggattatgataaaatgcttacagctcataaacaacgtaaagctgatgccactatcgctgtattaaatgtatcattaaaagaagcaagccgttttggaatcatgaatacttatgaagatggaactatttatgaattcgatgaaaaaccagaaaaaccaaaatctacattagcatcaatggggatttatatctttacttataagcaattaagaaaatatttaattgcagatgccaaaaaagaagatagtaaacatgattttggaatgaacattattcctgacatgttaaatgataacaagaaattatatgcttatgaatttgatggatattggaaagatgttggaactgttgaaagcttatggcaggctaacatggacttgttaaaagataaagatcttgatttatataacatcaagaaagattggaagatctatactgaagatactttaggaaaaccacaaattatcggggatcaagctaaagttaaaaattctttgattacacaaggatgtttagttaatggtaatgttgaaggatcagttttattcaacaacgttaatgttggtgaaggggctaaagttattgattcagtattaatgccaggggtattagttgaagaaggcgctgaagtgtataaagcaattgttgatgaaggtgtagttattcgtgcaaaaactaagatcaacaaagaagctaaagaagttgctttggttagtgataataagtaggggaggaaatagagatggtaaaagcaattggtatagttaatttacactcagatgtagattttgtcggtcttacagagagaagaccagtagcgtctgttagttttttaggacgttatgcattgattgatttcgtattatctaatatgtcaaattcaacaattgatgcagtcggagtattgattcaaaaaaaaccaagatcattatttaaacacttaggtaatggtgattcttggaactttaactctaaagctggtggggtttcattattatataatgaaaaatacgccaataaccctaattataatcatgatattaataatttaattgaaaatatcgcttttttagaagctaataaggctgattatgttgtgattgctccagcacatatcataacaacaatggattatgaagatgtaattgaaaatcacgaaaaaaccggtgctgaaattacaatggtatataagaaagttcatgatgctaatgaagcatatattggatgtgattgcttaacgatcaaagataaagttgtaacggctgtagaacgtaataagggtagtcgtaaagatcgtagtatttcattagaaacttatgtaattaatacaaaaactttattaaaagtaatgaagcaggcgcaaaaaatcagttcattctttagtttaaaagatgtactgggttatttatgtgatgaaaaacaaattaatgcttatgaatataaaggttatgcacgctgcattgattcattagaacattattataaatattcattagagttcttagatttagatgtgtcatcagcagtatttaaaagcaactggccgatttacacaatcacaaatgatacacctccagcaaaatatttaacagaatcagatgtaacaagatcatttgttgcaaatggagcaatgatcaatgggacggtggaaaatagcataattggacgtgatgtagtaattgggaccggtgcagtagtaaaaaattgtattctattctcaggttcagtggttaatccaggagcgcatctagaaaatgtaattatggataagacttctaaagtacaacggcaattgaatttaaaaggtgacgcaactacgccattgtatattaaagaaggagatgtggtttaatgcgagttttatttgcaacatctgaagcgacgccgtttatcaaatcgggtgggcttgcagatgtcctaggttctttaccaaaagagatggtaaagaaaggtgttgaaagtattgtagtgctgccaaagtatcaagatatgaaattggctgatgaaattgaatatgtcactagttttgatatttgggtaggatggcgaaaagtatattgtggtgtgtttacttatgaattagacggggtacgtttctattttattgataatgaacaatattttagaagacctggtttgtatggctatgatgatgattatgaaagatttgcatattttgattttgcagttcttgaattgatttctcatcttgatattaagccggatgttcttcatttgcatgattggcaaacagcgatgattgcgatgttatataaagaaagatattgttattatgaacattacgataatattaaaatcgtctttacaattcataatattgctttccagggaaaagctgaccctaaattgttaagtgagttatttggattagataattatttatactataatggtaattgtcgaaatgatggatgtttaaatatgatgaaagcagctattttctatagtgatattattacaactgtttcaccaacttatgcacgtgaaattttaactccagagtatggagaaggtttacaaaatatcttagaaatgcgaaaatatgatttgtatggtattttaaatggtgttgattatgatgtaattaatccagcaacagatcctcaaatcgttaaaaattatgatttagagacggtgtttaaagataaaattgtaaacaaattagctttacaaaaagaagtgggattgcctgaagataaagatgttgcactaattgggatcgtgacacgattaactaaacaaaaaggattagatttaattatcaatcaatttagtgaaatgtgcagtcgtaaggttcaaatcttgattcttggtgccggtgatcaggtttatgaagatgccttaaaaggaatcgcatatcaccaccaagatactgtttcattacagttaaaatacgattttgggttatcttgtcgtatttatgcagggtgtgatatgttcttaatgccatcgttatttgaaccttgtgggttatcacagatgatgtctcttcgatatggaacgattccaatcgtaagggaaactggtggtttaaaagatagcgttgagccatatgatgaatatgctgatactggaactggatttagttttgcaaactataacgctcatgaaatgatgaaaacaattgactatgctttaaaggtttacgatgaagatcctgaggcatggaaaggaatcatgactagagcaatgcaggcaaagttagattgggatgctagcgctgaccaatatttaaaagtatttaattcgttaataggataaaagacagagcaatctgtcttttcctttccaaaggagaaggtatgataaaagcaattttttttgatgtagatggaacattgatttctaaaagcagatcagtgcttagtgagggtgtaatagcagctttaaaacagcttcaagaaaagggaatcaaattatttattgcaagtggacgtcactatttagaattagatgagttagggataaatactcaatttacatttgatggttacctaacattgaacggagggtattgttttaatcaggaaggggttatttataaaaatcccattaattctaaagatgtagaaagaatcgttgatcatgtaactaaacatcagttggcttgtagttttgttgaaggagatgatttgtatattaatttaattaatgatctggttgttgctgcacagacggcaatcaatacctcattaccaccgaaaaaagatgtttcacgagccttgattaatgatgtttatcaaatcgatccttttgtaacaaaagaggagatagaagaactggtagctttaacgcaacattgcaaatatactcagtggcatgatggagcttatgatattattcccaagcaaggtgggaagcaagaaggaatcagtgctatcttggatcattataaaatcaaggttgaggaaacgatggcttttggtgatggacataatgatatagatatgctccagtttgttggtacgggaatttgtatggaaaatggctgtgcagaaacaaaggcagtgtgtgattacataacagataatgtcgacaatgatgggattgtgtcggctttacgatattttggcttattataaaataattgtgggctaaataaggttgtaatcggttggagagttgtgtaaaatgggatagtagaggagtggttgtaatgaaaaaaataatgaaaatacttgttacaactttatgcttgtgtcttgtgacagcttgtggcgcgcgggataaagatgttaacttagaaaaaagtggaactaagtatagtactgatgatggagttagtttttattatccaagtaattatgagattactgcaaatgcaactgatacagatacagtagaattctctaaggacaacaacacattgtattttaaagtaattaaagatgaaactgataatgttgttgaagataaagatgaattatatactggtgaaattgagcaaagtggtgcttcggagattgaggtatccaaaccggttttagacagtggtcttgatgtttatcaatatgtatttgttcatagtgatactggaattagagccaaagagatagtttactttagtgatgataatacttatatttatggatatcgtgctgctaaagatgattttgaggataacgataaagatatgacagtatatttgcagagtttttctatggcaacaggtaaataagttgtatttcgtgaatgattttgttaagataaacatatatttaaattataggtaaacgaagtagattattagaagttaatagagatagcctgatggtggaaacggctaaatggaaataattgaactgcccttatctgagtcttttgaaaagaaagaacgtgaactagcgttaatagtaatcttaaagcatctattatcgggtggaagaacacaatggtgtcctgatagtaatatgcttttttatttatggaggtaatgatgaaaatatttaacacccttacaaataagaaggaagaatttaaaccgcttcgcgaaggtgaagtaagtatttatgtatgtgggccaacggtttataattatgttcacattggtaatactcgcccgatgatcgtctttgatgtacttagaagaacatttgagtatttaggatataaagtgacttttgtatcaaactttactgatgttgatgataaaatcattaaggcggctaaggcagaaggaataactgaaaaagaacttactgataaatatattgctgcttatgaagatgttcgtcggaatttgaatttattattcccaacttatgcacctagagttacgaatacgatggatgcaatcataaaatttattgataatttagttaagagtggttatgcttatgaggttgacggggatgtttattttagagtatctaaaattgatgagtatggacaattatcagggatcaaaatcgaagatttagtagctggagcgagtgaacgaatcgatgaaaatgataaaaaagaagaatcaactgattttgcattatggaaaaagacggatgaaggtattcgctttgatagtccatggtcaaaaggacgtcctggctggcatactgaatgtgtagttatgatcaacgatatttttgaaggtggtaagattgatattcacggtgggggacaggatttgaaattcccacatcatgaaaatgaaattgctcaatcaatggcttgtcatcatcatccgattgcacatacttggatgcataaccaaatgatcaatattgataatcaaaaaatgtctaaatcactaggaaatgttatttgggcaaaagatatggttgctgaattgggctgtaatgtagttaaatggtttatgttatcaagtcattatcgtaatccattaaatttaacggaagaagttttgaatagcgtgaaaaaagaagttgctaaagttgataatgtaatcaaatcagtttctttgtatttacaagttaatcatatcgctaatgaaaattataataaagcggcagttgatgggatggttggagctttagaagatgatttaaatacatcgctggctttaactaaaattcttgatcaagtaaaaaaattgaatctggctttccgtcaaaaagaaaagaatgataaagctatagcaattgaatatcaaacactattaaaaatgactgcagtgattggctttgtttttgaaccgcgtaaattaaatgcagcggaactagagatatatcaagcatggcttgaagctaaacaaaataaggattttgaaactgctgacaaattaagaactcaattaattgaaaaggggatcatttaatgcgcccggaattaatcaatgcaagtgtattagcttatctgggtgacagtatttttgaggtgctagtacgtgattatttagttaaagaaagtggttttgttaaaccgaacgatcttcagcgtgaagcagtaaaatatgtatcggcaagctcacatgctgcatttatgcatgatatgctggatgaagaattttttagtgctgatgaagttggaacttataaacggggacgcaataccaaagggagtaaaaatgaaagtcttgatcatatgcattcaacaggatttgaagcagtcattgggactttatacttagaagaaaactttgatcgaattaaagtgatctttgagcggtataaacaatatattaataataaataaaatcgagataaatttgagacgaaattaggtgaaaaatatgaaacaatatatatatggtaaaaacacaatattagaagctttaaagggagataagagtgtatatactgtgtatgtccaaaacaatgctaaagataatggcataattgagcaatgtaaaagaaaaaaaattccattcaagattgttgataagtctgaatttatcaagaaacttggaaatgttagtcatcagggagtgatggcggaaattgaagaatatcgctattatagtattgatgagatcatcaatactattcctgatggtaaacagccactattattaatgcttgacgggttagaagatccacataatctaggagcaattttaagaacttgtgatgctattggggttgatggtgttatcattgggaaaaatcgtagtgttggtttaaatgggacggttgcaaaggtttcaacgggtgctattgatcatgttaaggttgctcaagttacaaatttgactagaacattagaggatttaaaaaagcgttctttttgggttgttggctgtgatttagataaatcccaagattatcgtcaggttgattataatatgcctttggtaatagtaatcggttcagaaggttttggaatatcaagactagttaaaaaaagttgtgatatcaatgttgtcttgcccatggtagggcatgttaattcgttaaatgcttctgtggcaacagcagtgattttatatcaggtatataattctcgtaatcctttatagtaggaaggaggtaaccatgaatggttacgaaatcgaagaattgtattatttatatcgtcaggggtgtccgattgcacaggcacttttgattgaatattgctactggcaaattaagatgatgatgccggcgtattgttatacgatgacatcatatcagagtgattataaagattatcttcaagtagtaattattcgttgtttattggctttggataattatcgtcctgatcgtggcatgcaggttagaagttttatttcaatggtgatccaaaatacgattagttctttaattgtcaaaaaccaaggtaaagtagttagggaacggcaaactttattttctttggatgattattgtagtgatgatgagcgaatcagatatgtagatgcaatcgctgataataagagtccagatctactattaattgatcaagaacaacaaaagagggttgatgcgtatattttaaatgtttgctcggcttgggaacaaacggtaattgcttatcataagtgtggttttaaagaccaggatattgctttgaagcttaataaagacattagaagtatctataatgctaattatcggattcaaaaaaagatggaaaattcaaatctatttgactagtctgtatatttatgataaattataatagcgtagaaatgagctgattatatgaaacaaaaagttattttagtgtgtagtgagtgtttgtcacggaactacaccattacaaaaaacaaacgtgtaaatgtagaaagactggaattaaacaaatactgtaaaaaatgcgggaagcataccttgcataaggaaacgaaataggaggactaagtgtgaaatttcgcgattggtttagtttaaaagggattagaaaagaaattaaaaatgtcagttggttatcaaaaaaagaactagctcaaaattcagcaatagtactactattttgctttgtaatggggttatatttctttgccggtgacgcaattattgcatttattttaaagacattggggatgaactaaaatgacaggaatgaatgatgaaggaagacaatggtatgttgttaatacatactctggtcatgaaaataaagtaaaagaaaacttggaaaaacgtgttgaatcaatgggattacaagatatcctatttcaaattgttattcctgaacatgttgaaactgaaattaaagatggtaagaaaatcaataagactaaaaacatgttcccaggttatgtattagttgagatgatcatgactgatgaagcatggtatgttgtccgtaatacttctggggttacaggatttattggatcatcaggtggtggagcaaaacctttcccattacaaaaaagtgagttagatccaattttaaagaaaatgggattaagtacatcaagtattgaggttgattatgctgcaggtgatgaagttaatgtcatctctggaccatttgctggtaaaagtggtaaggttgaatcaattgatttagaaaaagaaactgctaaagtattagtggacttcttaggcaacttaacaccaatggaaattgaattagtacaattagaaaaagcagatttgtagaattcatctacaaatctttttttatgagtaagtaaaacaaataatttattttacttaaaaatgtcgattattgcgactaaatttactgaaaaatagttgacgtggacttataaagtggtatactaaaatagaaataggattgttactttaagtaggcaagaccaagaatcatacagttttttactgttgatttttggtcttttgtttttatttagtaatgatacgggaaaatgaggagaaacgggtatggagaaaacgaaagtaaaaaaactagtgacttcagcaattacactatcaatggcatttagtacattggcgccaagtatggtttttgcaactgatgatgtaaaacctcgtgatattgtaactaaagtcaatcatgcgttgaatgggacagcaacggcaaacaatagcgagacaagttattgggggccagataaagcaattgatggaatcgtaaatcgcgatgctgctaaacctgatcagtcacgctggtcaacgaatatgggaacaacaccgatggttttaaccattgatttaaaggaagaaaaagcgtttagtgaatttaaaattgaatgggaaagaaaaaatattaaaggttttaatattagtatttctaatgataataatgaatatacaccagtatatactaaaccagatgatagcaatatcacttcgttaactacaacagtaacattagaaaatagtgtgagtgcacgttatgttaaattaacagtagataattatgatgatactgaggcagctggctgggcttctgtatcgctatatgaatttgaagttttaggtgaggaatcttatgaaaatttagctgttggggcaacggctgtagctagtggttctgaaacaactagttttggcccagctaacgttgttgatgaaaatatgaaaacacgttgggcaagtacggctaatcatgatgatgataaatggattagtttagattttggaactgctaaagatattgcttcagtcactttgaaatgggaacgccgtaatgcaacaaagtacaaaattcaatcgtcaaaaaatgggacaagctgggaagatgtaaaaacacttactaaagcacctagagaatttgatgatattattaattttgacaatacgattaatactcgttatttaagagttgttgtttcagattttgaaaatctagcggaagatcgagatggtaagagtgttaattggcctacagtatcattatatgaattcgaagcatatgcagttaaacaacaggtagatagcgaacagattgtaacgattgatgatgtaattaataatctagtaattccagcggtagctaaaggagatacaaagatggctttgccccaagttcccgagggatttgaaattgagtttattggtgctgattatgaacaaatcttagatcgtgatttaacgattcatcagccaattgtggatacaatagtatctgtaaattataaagtaaaaaaaggtgatcaagaaaagatcacaggtgcatataatgtcacgattccaggaaaaaatagtcctgatgtcagcattaatgctaagcctaaagtagttccagaattagccgaatgggtaggaacagaaggaagctttacaattagcgatgattctcggattgtgatcaatccagcttataaagatgatttagcatatttagctaaaacatttaaggctgattatcaagcacaaactggtaaagaaattgaagtagtatatgccaatacaccaggggcgcatgatttctattttacattaggaagtagtgataccgggttaaaagaagaaggttatttaatgactgttggagatagtgttaaagttgaagcagtcgacaaaacaggggctttctgggcaacacaatcaattttacaaattttaaagcaaaatagtaatacgatccctaatgggcaaactcgtgattaccctaaatatgaagttcggggattcatgctggatgttggaagaatgccatattcattagatatattaaaagatattgcaaaaaatatggcttattataaaatgaatgatttccaagtacatttaaatgataactatatttgggttgaagattatggtgataatgcttttgatgcttattctgggtttagactagaatcagatataaaagcgggtggtaatggtggattaaatcaagctgatctaactagcaaagatgttttttatacaaaagatcagttccggacatttatccaagaatgtcgggatatgggggtagcggttgttcctgaatttgatacgccagctcattctctagctttaacgaaggttcgtccagacttagcgatgaaagataaatctgtagcacgtcactgggatcatttggatctagatagtatgtatgatgagagtttagcttttactcaatcaatttttaatgaatatatgaatggtgatgatccagtttttgatcaaaatacaacagttaatgtaggtactgatgaatatgatggtaagtacgcagaaaacttccgtcaatatactgatgatatgttaaaatttattcaagatacaggacgcgatgttcgtttgtggggaagtttatcaatgcgcaaaggttctacaccagttcgttctgaaaatgtgcaaatgaacatttggaatacaagttgggctaaccccaatgaaatgtataaacaaggttttgatttaattaatatggttgatggaactttatatatggtgccgggggcaggttattataacgattatttaaatagtcaaaatatttataataactggcagcctaataatatgggtggaacgatcattccggccggagatgagcaaatgttaggttctgcatatgcaatttggaatgatatggttgataaaaaggcgaatggtataagtgaatatgatatttatgatcgttttgaaaaagctttaccggcaatgtcatctaaattatggggcgatggtcaagatttaaaatataatgaattaaatgaagtagttaattcattaggaactgccccaaattcaaatccgcgtgatgttgtaacgagcaaaagcgatacagtattaaactatgattttaataagagtgaaatcgttgataaatcaggaaacgagtataatgtcgttaataaaaagaatgttgcaactgtagcaggaaaattttctaaaggcctagaattaagtggtggtgaaagttatattgaaacaccattagcagatatgggaccgaataacagtgtatctttctgggtgaaaatggataaagacgcaactggtgaacaagttttatttgaatcagataagggttcaattaaaatgtcacaaaaagatactggaaaagtaggcttctcaagaatcggttatgattattcatttaattatgaattacctaaagacgaatgggtaaaattagaaataaagggatatgctaataaggccgaattgtatgttaatggtgaattagtagatactttagctaaaaatgcaactggtggtaaatacgcaacgttaactttaccattagaaagaattggaagtaagacaacatcattcaaggggattattgataatttagagatttcaactactggtagtcaaagtgatgacactgattatacaaaggtagatagcagtaactttactgtatctacagataatgaaaatcctcaagcgggtaatgaaggaccgattacttatgcatttgataacaatgaggttactttctggcatagtaattattccccatatcaagctttaccagcaactgtagagattgatatgaaagaagttcatactattaatcaatttgattatctaccacgacaagatggtaataccaatgggcaaattactaaatatgaattatatattaaagaaaatgcggcagatgaatatcaaaaggtttctgaaggagaattggctgccaatgcttcgttaaagaaaattacttttgatgcagcgaatgctcgatatattaaatttgtagcgttagaaggtactggaaatggcggaaaatcatttgcttgtgcttcggaatttactgtacgtcaaattgactctaaggcagaattaagaaaagtagtcaacttagcagctaattatgaaaaggaatattatacaactgcttcatggaatgattttgaaacagcattaactaatgctcaaatgattctcgataaagcagatgcttcatcaacagagattgatgacgctgcgagtgctttaaaaacagcgattgatagtctggttgaaattggtgatgtggttaaaacagagcttgaaagagttattgctgaagcgcaatctatcgatactacaaaatataccgataaaacagtagatgttttaaaaacagcattagtaaatgcaattagtatcaatggtaatgaaaatgctactcaagaagaagtaaatgcagcaattacagcattaactaatgcaattgatgaattagaactaaaaacagatgtatcagttgataaaacagatttagaagctttattaaatatttgtggtacaattgatttgaataattaccaagaaaatggtaaagctgaatttaaggcggcttacgagtatgctttatcgatctttaatgaagctgatgctacagaacaagaaattagggatgcaatgaataggctgttggaagctaaaaagaatttaaaggaaattgaagtaactccaactgatcctgacaaaaatggtcaagataaacctattgacaataaagttgaaacgggagataatataaatgtgctttattctgcgtcaggattagcattggcatcaattgtgttttatttcagtaaaaaaagaaaaagatctaattaaaaataattaaagatagggggagagctaacgctgtccctctttgtgtataatttagaaaattaggtttgataatatagcagtttgatcccgttctttaaaatatttcaaaatatgaaaaaaggagtttgattaattgattaggggcaaaaaaattgaaaaaattaaggaatcatggggattttagatggtttcatatattaaacttcttctttaataattagaatttgtatgatggaatcaagaaaatttgcatttttaattcagatatgttattatgcaatggtacgttttagataggaagtgagttaatgaaagaacagcgtgttaaacaattgaataattttattaatgaaaatattatcaaacggaaagctatgtttatcccaatcttaggggtatcagtatttatgttagtaggttatgccgcggtcgataaagaagcaccaaaaattgtttctaatcgaatcgaggtttcatatggtgacaaagtagatttagatgctattgatattacagataatcaagatagtcgtccggaaatcgaagttactgcaaatgatcttagcagcgtgaatgttaatcagttaggtacatatgatttatcagtcacggcaacagatagtttttcaaacacagcatctaaagttattaaagtagatgttgttgatgatgaggcaccaaaatttaaggttgctggagtcgaaacagggtatgtcgtacaagtaccgatcaatggaagtcaagatatttccagttatgtaactgcttcagataatgttgatggtgatgtttcgccattcattgaatcgaatcaggaattagatacgactaaagcgggaattcaagatattaaattatcagttaccgattcttctgggaatgtaaatgaaaagacgtttacttttgcagtatctgatttgactgctccagtagttactttatcacaaggaaatgatattgtaattgattatggtagcgaatttaaattagagaactttttaacagctactgatgatcaaagtgctgttaccaacactgttactggtgaagtagacactaagaaagaaaatgaagtacaaacaattactgttagtacgcaagatgaagctaaaaatgaagttttaacaactttgaattttacagtaaaagatataagtggaccacaagttaatttgtcaacaaatgcagttgaggtaattaaaggtgatgcttttgatccaagacaatatttagtctcagctattgataataaagatggtgatgtgactggtaatgttgtaatcggtaatattgatactggcagcacaggagataaagctgttacttatacagtaagtgatagttctggtaatcaaacagttgcaactttaaatgtaaaggtttatacaccgggaagtaaaattttagaaactgcttatacaaaactaggtagcccatacgtatggggagccacgggaccaaattcatttgactgttcaggatttacatcttgggtatatcgtcagcatggaatttccctttcaagaactgcgcaagctcaatctcaaggtggtaaagcagttgatcgtgcagatttacaaccaggagatttagtcttctttggttcaagtacaagtagaattactcacgttggaatttatgttggaaatggacaaatggttcattcaccacaaactggagatgttgtaaaagtgtctagtttaaatcgtaattacgtgtgtgcaagaagatatttatagaaaagggcgtttgtccttttcttttttttatatttaggcataagaatataggggaggtatataatgaatagttttgatcttattagggtattatgtaatactagtcctaaagcttatgctttaattacaggagcaacagttacgggaacaatgctagcatatagttttgaagaaggaacgatcgttgtggttgaggctcaagggttaccggctaccggttgtggtttaggggtacatggtttgcatattcatgaaggttctagctgtagtgggacaccggaaaatccttttggtaatgctggaggacattatagtacgacaaattgtccacatccatatcatactggggatctgccacctttattttctgaggacggacaagcttggatggcggtatatatttctaaatttacaccagagcaaattgttgggcggactattataattcatggaaatgttgatgattttactactcagccatcgggaaattctgggccgatgattgcttgtggtgtgattagggaattatatcaataatatttacttttcttaagttaaaaaacaatctaactatggtacaatgtagtggcggaggtatgaagatgagtaaattattattttttgatatcgatggaacactgattgagtgtaatttagatatctattcaattactgaaaatactagaaatgcattagatagattaaaagaaaatggacatgatgttttcttagctacaggacggtgtaaatgttttattactgaaggggttatgaattatccttttagtgggtatgtgacttgtaacggagcttatgtagaatatcatggtgagccagtatataaagcaataattcctagtgaggcaattaaagcaacgatggcgttatcagaacaatacgattttaactattattttgaaagtagtgattatatctatgtccgtgatcaaaatgatgaacgtcatcagtggtttgcaaaaaattggggcatgaaaccggagacagttattgatgattttgatccagaaacgatagaaacttacattgggatgattgttgttaatgacaaaaaagatatttcgccaatggttaatgcattgagtaaatattttgatgtccaaagacatcaaagtgattattcttttgatttaactttaaagggtgtctcaaaagcagttggaattgaaaaactggtagaacgaattaatcgaaatattgatgacactattgcttttggtgatggacgaaatgatattgagatgttggaaacagttaagattggtgtagcaatgggaaatgctgttgatgaggcgaaggctgttgctaactatgaaactgatcgaatcgaaaatgatggcattgttaaagctttaaaacattttgaattaatttgacagccttagggctgtttttcagttagttctttattaaacgggtatacttaaagatgtctacaacattcgcttgaaagaagggatgattgtgctatactttaaccatagtgtttttagatttgagaaaggagataggtgttagtgccttgttagatatgatcttacaattattttgtttaatagctggttttgtcttattgattaaaggagctgatatttttgttgagggagcttctaagctggcttcaaagctaaatattcccccaattgtaataggtttgacgatcgttgcttttggtacaagcgctccggaagctgctatttctattacttcggcgttaggcggtaatgttgatttagcagttggaaatattattggcagtaatataatgaatgttttgttgattctaggaattacctggtgtatcgctaaactgaaggttaataataatacatatcgatatgaaattccttttgtaatggtaataactctagttttattaatgttaggaaagtttggcagatcgattgatcgatttgatggagtgcttttatggggattatttttactgtttttatactatttatatcgtttggttaaaaagggtgaagaagtgccattggatgaagttgaagaattagatgaaaaagatacgctgctccgactaatcatcatgattgttttaggaatggcggcaattgtaattggtagtaatctaacgattgatgcagctacatatattgctgaagaattaggggttagtcaacgtttgattggattgacgattattgcttttggaacatcgttgccggagttagtgacttcaatgacagcagcttggaaaggtaagagtgatctggcaattggtaatatcgtcggaagtaatatttttaatatcttgtttgttttaggaacaacagctttaatttccccaaaagcagttgcttttgaaagtggttttattattgatggaatcgttgcaattggggcattgtttctattatatacttttattggtagcgatgggtatttaaaaaagagtggggcaattattatgctgattggctatttggcatattttgtaagcattttataggagaaatatatgattaaattaggtcatcggggatatagttctaaatatccagaaaatacaatgttagcttttaaagctgcaattgatggtaattttgatggtgttgaaacagatgtacaactaacgaaagataataggctagtcttgattcatgatgaaaagattgatcggacttctaatggtaaagggtatgtaaaagattatacctatgatcaattgtgccaatttaattttaactatcgttttgatggaatcgaggcaaaaattccgttgttagaggaattgttagattattgtattggtaaagatgtaatcttaaatattgaaataaaaactgataagattcagtatccgaatattgaaagaatgacttatatgatgatcaaagaaaagggcttattagatcgagtaatgttttcatcgtttcatttagagagtttgcttaatcttagagaacttgatgatagtatttatcttggctatttgtatgaagataattatcaagtcaataaagctaaagtatttgaatatcgttttaatggagcacatcctaaatatacttttttaaatgaaaaggaaatcaatgattatttgcgtcggggtatagatgtaaatacttggacagtagatagtgatgatattaaagattttttagttgatgagggtgttaaaacaataattacgaataaagatatctagggtaaaaagaccctagattttttctcatccagtaaattaagcagtgatacaagtgttagcgttttcattgtaaagttagtgtttttgttgtgaaaaaatgcacaatattacttgtgttttttgcaaatttggggtacactatcggtggaaacaaattaaatatttcacaatgaatcggaggaagaaataatggcagaaaaaaaagctgttaacaaagtagttgaaccaactaatgaagaaatcgatgctcatgttgatcaactagttgcaaaagctcaagtagctttatcaaaatttgaagaattcactcaagaacaagtagattacatcgtagctaaatgttcagttgctggacttgatgctcatggtacattagctgaagctgcagttaatgaaactggacgtggtgtatttgaagataaagcagttaaaaacttatttgcttgtgaatatgtaacaagtaacttacgtcacttaaaaactgttggtatcatcaatgaagatccacttttaggaatcactgaaattgctgaaccagtaggtgttgtttgtggtatcgttccaacaactaacccaacttctacagtaattttcaaatcattaatttgtttaaaaacaagaaacccaattatcttctcattccatccaagtgctcatgcatgttcagtaatggctgctgtagtaattagagatgctgcaatcgctgctggggctccagaagattgtatccaatggttagatcttaaatcaatgtatgcaactactgcattaatgaaacacccaggtgttgctacaatcttagcaactggtggtaatgcaatggtagctgctgcttactcttgtggtaaacctgcattaggtgtaggagctggtaacgttcctgcttatgtagaaaaaacttgtgtattacctagagctgtaaatgacatcgtattatcaaaatctttcgataacggtatgatctgtgcttctgaacaagctgctatcgttgatactgaaatctatgatgcattcatgaaagaaatcaaaagattcaaagtttactttgtaaataaagaagaaaaagcaaaattagaaacatttatgtttggtgctgtagcatacagtgataacgtaaacgctgctaagttaaatccaaacgtagttggtaaacctgctacttggatcgctgaacaagctggattcaaagtaccagaagatactcaaattatctgtgcagaatgtaaagaagttggtccaaatgaaccattaacaagagaaaaattatctccagtattagctgtattaaaagctaaaaatactgatgatggtatcttaaaagcaactcaaatggttgaattcaatggtttgggtcactctgctgcaattcatacagaagatcatgaaatttctaagaaatttggacatgcatgtaaagcaatccgtattatcgaaaacgctccatctacattcggtggtattggttctgtttataatgcatttattccatcattaacattaggttgtggttcttacggacataactctgtatcaaacaacgtaagtgctgttaacttaatcaatattaagagaatcgggagacgtaataacaatatgcaatgggttaaacttcctccaaaaatttatttcgaaagaaattcgattaaatatttaagagacatgaaaaaaatggaaaaagccatgatcgttacagatagaggtatgtacaatcttggttatgtagaaaaaatcgaagatgttattagaagaagaagaaatcaagttgatttagaattattctttgacgtagaaccagatccaagtttcgatacagttcaagctggtcttgaattaatgaacaaattccaacctgatacaattatcgcattaggtgggggttcttcaatggatgctgctaaagtaatgtggttattatatgaaaatccagaagtatgtttcgatgatatcaaacaaaaattcatggatatcagaaaacgtgcattcaaattccctgaattaggtaaaaaagctaacttaatctgtattcctacaacttcaggaacaggttcagaagttactccattctcagttattacagataaatcttgtaacaagaaatatccattaactgactatgctttaactccaacagtagctatcgttgaccctgaattcgttatgtctttaccagctgcaattgctgctgatacaggtatcgacgtattaactcatgcagttgaagcttacgtatctatcttagcttctgactttactgatggatgggctaaacaagccgttaaattagtatttgattacttagaagaatcagttaaagaaggaactcctttatctagagaaaaaatgcacaatgctgcaacaatcgcaggtatggctttcgctaatgcattcttaggtatgaaccactcattagctcataaaattggtggggaattccacgtacctcatggacgtactaatggtatcttattaccacacgttatcagatataacggaagtatgccaactaaattaaacatctggccaaaaattgaaaacttcaaagctgatgttaaatatatggaattagctcaattaatcggattaaatcctaaaactcctgcagaaggtgttcaaatgtttgctgacgcttgtgaagaattatgtcacaaagttaatttagcatctaacatcgaatctcaaggaatcgataaaaaagattgggatgaagcaattcacagaatggctatgaatgcttatgaagatcaatgtactccagcaaatccaagaatgcctatggtacatgatatggaagcaatcttaagaactatttgggattataaaaataaattcgataaataataatgtttatctttgaggcaacaccaagtgttgcctcttttttattagacactttgtgttataatgggcatatattaaagtatcggggtgtgatttaatgcgacgtaatatttataattcaatatattattgtgttttagggttgattttaattgttatttcatcaatggcaattattcagcgagaagattttttaatgcgtgtatttgacgtattggcatggattttgattattaatggtcttcatgaattaagtgtatttttaagacgtcgctttagaggagatttaattaatataattggaaatattggagtaggaatatttattttgtcttatacagcgattccaattagattattatttgctatttttgcaatctatataacattaaatggaattataaaatttatttcttatttaaactataaaaaagataaagtgagtaaacgatttccagttttgtgtggggctctgtttttgatcatctatggcttggcactgttattagggagatatgctgatgctaatgcaatgatgatcttcattggcggttatggcttattattaggaataaattacattattgatggaatctttaccgctattccccagcagcataaagacagtttaaagagacggatcagaatacccgtaccaatctttatttctgcccttgtaccaaaagtgatgatggattatataaatgaacggttagcagttgagccaacagagaagtttttagacgatcagaatcacgcaaatgtagaaatttttattcatgttagcccagatggatttgggacaattggacattgcgatatatgtatcgataatcaagtaatatcttatggaaactatgattacgattctattagattatttgaaaccattggggatggtgttttgtttattgctccacgagaaagttatattccattttgcatcgaaactgatcataaaacgatttttagttatggggttcgtttaacagttaaacagttagcgagtgtaaaacgagaaattgaaaagttaaaagaaaatacctacccttggtatccgcgttcatataaagataggaatgattgtaatgactatgccagccgtctttatttacgaacgggagctagcttttttaaatttaaaagaggacgctataaaacatattttgttttagggtctaattgtgttaagttagctgaagcaattatgggaaaagcaggaatggatattattgatttaaatggaattatttctccgggtacttatcaaaactatttagagaaggaatatcaaagggcaaatggtgttattatttcaaaaaatgtttataaccaattgacaattgaccataaatgagacataataatggagtattatggttatgtcaaagaaagacaataatactttgcataggtgacccctctcccatataatcacctatgcagaaaaggaacaagaaattgttcctttttttatacattttttttaaaagttcataaagtgttcacatttctccgatattattacaaatgtcgtcaagacaagataatatataagtataggtcacccccttcttccccaagaacgacctatacattaaaggaagtattccccaatgcttccttttttttttatttgttagtgcaaaaaaattcttgcctagataataaaaatttgctagaatgtaaaagggcaacagtgtgtcttccagaggaagacatttttattttgatataaaacaaaaaggagaatagaaaatggcaaagtatatatttgtaacaggtggggtcgtatcaggccttggtaaaggtttaactgctgcatcgttaggtcgaattttaaaacagcgagggttaaaagtgtttatgcaaaaattagatccttatatcaatgttgatccaggaacgatgtcaccatatcagcatggtgaggtttttgtaacggcagatggtgctgaaaccgatttagatttggggcattatgaaaggttcattgatgaagaattaaatcgtaattcatctattactacaggacgaatttatagtaatgttatatctaaagaacgtcgaggggattatctaggagctacggtacaagtggtaccgcatattacaaatgaaataaaagcaaaaatttatgctgcagcatcaagttctaatgcagatattgtaattactgaaattggaggaacgactggagatattgaaagtttaccgtttttagaagcaattagacaggtacgcttagatttaggttatgataatactctttatattcatacgacactattaccttatattggagcgagtcatgaggttaaaactaaaccaacacagcatagtgttaaggagctaagaggtttagggattcagccagattttattgtatgtcgaagtgagaagtatattgaacaagagcttaaagataaaatttcattattctgtaatgttccaacaaaaaacgtaatttcaaattatgatgttgaagtattatatgaattaccaatgatgttattggatcagcatatggatgatcttgtccttgaacatctaagaattgaggccccacaaccaaatatgagtgagtgggagagtttgattgaacgggttaaaggtttagatcatgaaataacaattgctttggtaggaaagtatactcaattaccagatgcttatttgtcagtaaatgaggctttaagacatgcgggatattatgaaaatagtgttgtaaatattgaatttgttgattctgaggaaataacaaaagataatgtcgctgaaaagttaaaaacagcagatggaatcatagttcctggaggatttggtaaccgcggaattgaaggaatgatagatgcaattgaatatgcacgaatcaataacttaccattttttggaatttgtttagggatgcagctggcaacgattgaatacgcccgtaatgtttgcggcttgaaagatgctaattcattagaatttgatgaactaacaaaaaatcctattattaatttaatgtctgatcaatcattaactgatatgggtggaactcaacgcttaggtgattataattgtgaactggctgccggtacacatgctagagaattatatggggtcgatatgattcaagaacgtcatcgtcatcgctatgaatttaataatgagtataaagacgctttagttgaacatggacttacgattgcaggcattaatcctgaacgtaatttggtagaaatagtggaaattaaggaacatccatattttgtggcttgccaatttcatccagaatttacaagtcgaccaaatcgttctcaaccgctatttcagggtttgattacagccgctcataagcgaaaatatcatgggtaggtattgcacctatcctttttatatagtaccgtaatatgatacttagtgaataaatagtaactttagtcctaaatcaagatacaaactcccctaattagtcattatcattgtattcgcttacaactataataattgatataggaggaagtaaaatgagaaaaataaaaaaactatttgcaatgatgatgacattagtaatgaccctaggcattattacaacaaatattagtgcaatcgaggaattaaaagttacttcaattgttgctaatacatatgttggggatggacaaagagaagtgagttcatttgaaatcactgtcaatgatattaatttagtaaatgatttaaaggctgaagattttgatattactaataacgttagctcagtaccctacgacgttgcgacaaatgctttagcagatgattatttagatgatggaattagtttagaaattaaaggaaatacaattattcttaatgtaaaagcctttgattatactggacgatacaatcctgattttagtaaaaatccttggcaggttacctgcaacaaatatggtgtgttaagtttcaataaagataatgtgactacattgaaaacaaaaactttggatgatgcaatcagaggaacgtttacatatgcgggattaactcgtgagtatgctttatatttgcctaaaaatagtgatggaactaacatgaaaaatgttccattagtagtatggaatcatggtggtggagaatatgcagggcaattagaaaatacacttgttgctaatagaggtttaactgcatgggtagaggcaggatataatacagcggtattacaaattcaagtttctaatccaaactatagctacgggacagcttttgatgaagataagaaatctttgatcgatcaaaataacgctttacaagcagcgttaataaaaaaattaattgcagaaggaacagttgatcaaaatcgtgtttatgttacaggagcatcaagtggtggtggcgcaacgatgcgctttattatgcaatacccagaactttttgcgggtgcgatagcttgttgttcaatggatccgattgtgtgggtacattataattatcaagattcttatgaacaaattgttgaaaattttgaaactgctttccaaggacaagtatacacttgggatgaaacaaaagaaatgatggtaagcaaacaagttgatactgcttctttagtagagttaccaatttattttacacatgctcaaaatgatactacatgcaatgttaatagttcaaaagctatgtatgaagctttaaataatctaggtgctaaaaataatcacttaacaatctggtcaaatcaagaaatggctgacgaaggaattgctgaaggtttattacattggtcgtgggtaaaagtacttaaccataatgaagaaggttcaccaatgaattggttatttaaacagacaaatgcttcagaaaatattccagtagaaaaagaagagtcgaataattctaaaactgaaacaactgcttctgaggaagcaaagaaagcagttaaaacaggtgatgatagtacagttgaattgatggctatgatgactggattatcattgttagcgggaacagtagtattaagtaaaaaatattattaataataaaaatcctctaactgaaatgaacctcattatttgaacattcaaataatggaagattatttcaaatgaggattttttatttaaaattcgagtaatttcaccaaaaaattaatgaaatatagtatactaatacccagaggtgaaagcgctatgataaaaaatataactttattagatagtattttggatgttgctaactgtgtcgatattaatgataataatacctatattgctcggaaagtgatagagaattgtgtttggttaaaggatatgagtttagaggatttcttagaaacaactaatattaatgggagtcagtttaaacgattttataaattgtatgactgcaacaatttttcaatcttgaaagagcggattggcttgtggtgtgatattcgtaaagagcaagtagtaaaacagtgtcagtggcaaaaacaagaaccgcttgcaagagttatttttaacttaactaattataatgattttaatgatttttttaatgttgagttaattgatcggatttgcaagcaaatctatcaaagtaagcgtattatcatgtatggggcgatgggattgttgaatttaacacatgattttcaaatagatatgaaactgtttggaaaggattttattcgtagttcgatgtatgaagataaggctctagttcctcaaaaagatgattttgtatggcttttttcaatgatgggaagaacgatgaatatggtagggacaacaatgcgtttaaaaatctttaatggtccttgtaagaagttattaattactcaacacggggcattattagagagtgattttttaatttcattaaatactgataatgattattatgaggggcagtatgtttttatgttttatctagatatgattaaaacaagatattatgaattatatataaaggagaactaggcagatgattttggggaaggttatgatggctcaaagtgctaataagcgtgggagtgtagaatatcagatcagtaaaaaaacattgatgctcggaaatcgaatcaaagattattcattagaaatgtttattaaagaagctggggtatcaaaaacatcattgatgcggtatttaaatagcctgggggttaatacctttacttcttttagggaaataatcacattagagagtattaaaggcatcacagccttggaaacaataaaatataactataaggaagaacagctagacaaacaggctgttaaattaggaaaaataattaaagaggctaaacgtgttattgttttgggggatggtaattgttttagtttgatgatttatatgaaagcctttattcatctagggatagattttgaaattcctatttatttaggtaaggaggaggatatttttgatgaatatgcattatctaaagatgatctggtaatttttatcagtcttcatgaaacgtttagaagttttttagatcatcgaacgatgttttataaggatgttagatattttcaattcaattgtccgtgtcgagttgcatttgtgggagaagtagatttaggacaagaaccactaagtgaataccagtttatcgtagatattgatgggcttatatatgaacgtaaaatgcgtttagataagttatttgaagaggcaatgagttatttatgtcttagttatgaatttgtttattaattcttaagtttttattgatgggaatttttgtttgtttttgttataatacagtatattatggaggcggtaatatgcttgaaactaaatcaactaagaaatttaagataattaaaggaataatttgtattcttactttagcaatgctagtggcagcagtgatttttttattcattgttgatgatatgaaaaagaagcgacgtctgattttttcaattgttcaattattgttaatgataggaattataattttaccagaacagttaaaggaacgacttgatttaaaaattccgattatgttagaaacctcactaactgtatttgctttttgtggatttgtacttggtgatgtgtttgatttttataaaaaaatacctatttgggactcaatactacatgctttttcaggtgtgatcttagcttatgcaggttttgttttaattgattattttgttaaacgtgaaagtgtaaatatatcgatgggacatatgtttatttgcactagtgtagtattgttttcgttagcattgggtgctttatgggaaattggagagtatttggttgatgatatttttgggactaataatcagcagtatatgaagtctacgcgaggaactttatatggccaaaaagatgtgcctttagaaggacatgcagctttaggcgatacgatgaaagatttaatgttagacttagctggagcaacagctattgtaacaatagaatactgtaaagaggattatcgcaaaaagaaagctaagaaagaagataagtaaactttgagcattgaaaatgccctagaatatagggcgtttttgtgttagaatatggcgtggaggagtgagagtatgtatcgaattggacaatcaattgatattcatcagctagtagcaggacgaaagttgattttgggtggtgttgaaatcgaacatgagcgtggtttgttaggacatagtgatgctgatgttttatgtcatgccgttattgaaagtattattggggctttaggattaggtgatattgggaaacattttagtgacactgatgctcagtataaagggattagttctttagtgctattagaaaaaacttatgaaatgatggatgatcgcggttacgaaataagtaatcttgatgcaatcattttgattgaaaaaccaaagatggcacctcatatccaaaaaatgaaggaaaatattagcaggatcttaaaatgtgatattgctgatgttaatattaaagcaacccgtggtgagaagcttggctttgttggtcatgaagaaggtgctgtttctcaatgtgtggttatgttaaagaagaaagggatttaagaatggaaaaagtaagagtaagatatgctcctagtccaactggacatctacatattgggggagcaagaaccgctttatttaattatctatttgcaaaacatcatggtggagattttatttttaggttagaggatactgatattgaaagaaatattgaaggtggtgaggctagccaattagaaaatctagcgtggttaggaattattccagatgaatcaccattaaatccaaaaccagagtatgcgccatatcgtcaaatggaacgtttggatatttatcgtaaatatactcaagagttattagatcgaggtttagcatataaatgcttctgcaccccagaggaattagatgctgaacatgaacgccaagttgaagctggtgttgcaccaatgtataatcgtaaatgtcgtgatttaacagctgaagaagtagcagctaaagaagcagcaggaattccttatacaattagacttcgagtgcctgcaaataagacatatgagtttgacgatatgatccgtggacatgtatcatttgaatcgaatgatattggtgattgggtaattgttaaagccaatgggattccaacttataactatgcagttgtaattgatgatcataccatggaaataacacatgtttttagaggtgaagaacatttaagtaatacgccaaaacaaatgatggtttttgaaatgttaggatggaaagcaccgacttatggacatatgactttaattgtaaatgaacaaagaaagaaattatcaaaacgtgatgaaagtatcatgcaatttgtttcacaatacaaagaagaaggatatttaccagatgcaatgtttaactttatggctctattagggtggtcaccagaaggagaacaagaaattttcacaaaagaagaattaattaaagaatttagtgaaacgagattatctaaatcaccttcaatgtttgataaagataagttaacatgggtcaataatcgttatattaaagaaagatcattagaagatgttgttgcattatgtcgaccatttttagaagaggcttatgatctatcaagtaaatcagaacaatggatcaatgatttagttgcaacgtatcatgatcaattatcttatggtaaagaaattgttagtttagtcgatttattctttacagatgaattgaatttagatgaagaagctaaagaatttatgaaagatgaaactattcctaatacgttaaaagtatttaaagcgcaattagagaatttagaagaatttactaaagaaaatattcaagcttgtattaaagcaactcaaaaagaggctaaagctaaaggaaaaatgttatatatgccacttagaattgcaacaacaggaatcatgcatggacctgatcttgcgagttcaatttgcttattaggaaaagaaaaagtattatctagattagggtaaatatcgattaaggagcgtttaatttaacgctcttcttttttctgtaaaagaaaaaggattgatatattcattgtttgtgttatattgtatatacaatggaatacacggaggaggggtcaagttactattataagcaaggggaaagagtatgagtataatagcaaaactgaccgaaaagaaagatttttcagcgtcggaatctaaaatcgcagattatattattgaaaataaggaggagatattacatcttacaattagagaattagctaaaacaacatatactggggcatcgactgtaatgcgagtcataaaaaaaatttatgatggtagtttttctgattttaaggtcgatttagcttatgaattacaaaatatgatgagtaaaggaaataataaaatcttatttcaaataaaaaaacaagaaacagctttttctgttatggaaaaaattgcaagtgttgaaaaagatacaatcgatcgaacaaaattgttattgaattatcaacaaattgaacgtataactaagttgatcaacaaggctacaataatctatatttttgcagatggaattaatgagcagattggacacgaatttaagtatatgatggctcggattggaaaagctgtagagattgcaaccgataacttttgggtagcattaaattgtttaagtgaatcggctaatccattagcaatctatgttaatcatcgtgaacataatgttcaattattagagaagataagattaaatcataaaattgcaattcctgggattgctgttacgggatatattaattccacttttgaaacttgttgtaaagaagtgattactattcctactggagttagttattcagatctagctcctgttatttatacaactgcaatacgttatgttttaaatacgctcgtgggctgtgtgattgcttcaaatcatgaattgagtatggataaattgattgactatactgaattatcacagacagtgaaatagttttactttgagttggtacaatgtgccagcttttttttatttgtgagcttttatttagaaacattgttccaaaagaaatgcatatgtttaaaaaataacgtatttatgttaataatatggatagataataaatattaatggattgttactttcagtaggcaagaccaaagagcactaattaaagctttttagtcgtgccttttttagtgttttaaaggagggaacattaagtataaagtagactattttttaagaaaggaaagggaaaaatgagaagaacaaaaagaattatagcttctttagttgcagcagtaacagttatatcgcaagttatgccaatgatgaaagttactgcagcaactgataatgtcagattagcaacatttaatattgcggctaataaaaaacctgatataaccaagctaaatgaattattgaagacaaataatgttgatatcgtaggattgcaggaagtggatattaatacaagtcgtaatccatacaatatgttagagaagtttgtagagcaaggtgattatgcttacagttcatttcaaaaagcaattgaaactggtggtggtgattatggtgttgcactactgtcaaacttagaattaatcaatacaaatggtggagctttgagtagtgagggaattaaagaagctcgagcatggcaaaaaggagaaattgaagtaaacggtaaagttattgcagtttataatactcatttgacatatgagtcagtagaagctcgtgcgaaacagttattagagttaaaagcaactatggatcaagatccggcagaatataaagttgcttttggggattttaatgtagatcaaaatcacaatgaaatttatccatttttagaagattacaacattgcaaatggtaaaggtggaaagtggtacgatacctttaatggtactgatgcaagtatgaagactagtgcagtcgataatattattacttctagaaatttagaaattagtaatattacaatggttgaaacagatttatctgatcataatttattttatgccgatgctaagttattagatcaaccagttgcttctagagattatttagatcttgtgattagcgatgctaatgctttagatgaaggtaaatatagtaacgcttcttacaacactttagatgaaaaattggttgcaggggaactgcttgatcaaaatgctactcaagagcaaatcaataaggctgttaaagatattcaaacagcacaggataatcttaaaacaagatatcctaatttagctctaaataaagacgttagtgtatcaggactagaggtgaatgatggaagatggactgctccaatggcagtagatggtattgtttctagtgatagtcgtgtatctttggctaaagataaagatgagcaatggttagaagttgacctaggtaaaacagaaactatttctaattttgtgattaattatgaatcacaagtacctgctttcaagattcaagttgctggtgaagataaagtgtaccgtgatatttatgaggttagtaatttagaggggcaaattagcaatattcaaaagatttcaattgatcctactgaagcacgatatgttaaatatgtccaattaaaacgctggacacatagtggtaatgggaaacaatacagtggcagtatttatgaatttgaggtatatgaacaagatccagatgccaaagattacagtaatattgcattgaatcggcctgttagcgcttcatcattagaagtaggtgatggccgctttactgcaccaatggcagtagatggagtggtttctaaggacagtcgggtatcttttggtaaaactgcagataatcaatggttattagtagatttaggaagtcgtaagacagtatctgaatttgtaatcaattatgaatcatgcccaccagcatttaaaattcaagtatctactgacggtgtaaactatcaagatgtttatgaagctgctgatcttccagatggaggacctagtgaaattaaagagattcaaattgaagcaacaaaagcaagatatgttaagtatgttcaattaaaacgctggacccatactaataaaaataaatatagtggcagtatttatgaatttgaagtatataaagaaagagatcatacagttacaactgctgatgaagttttaaagtcattgaataaggaagcgccacaaatcaatggtaataaaattgttttaccagcggtacctgatggctttgaaattagtttatacggttgcgataataaacaggttgtagcaatggatggaacaattactcggccattggaagatatggatattaatgtattatatcaagttaaaaacttgaatgatgaaactgatattgcttatagtgaagccgatattaactttattgtacctggagcttataacaaggaagaaagtattaatgctaagcctaatgtaatgccgggattacgggaatggaaaggtaatgaaggagaattcacattatcaaagaattcaaaaattgttgttaaagatgccagtttggaagctactgctaaacaaattcagttttatttaaaagagatgatcaaacatgaacttgaaattgttactagtggtgaaaagagtggtgatattgttttagtaaaagatggtagtgttgacaacttagggaaagaaggatatacgcttgccatcgatgatatgattgaaattaaatctaactatgaaacaggaattttatatggtggtatttcaattacccaaatgttttcgcagaatgatgggatgaataatgtagctaaaggattagcgcgggactaccctaaatatgaggttcgggcaggtatgctagatgtagctcgtacttatattccaatggagtatttacaagaaatgacgatttatatggcatactataaacttaatgaagttcaagttcatgtaaatgattattggggagctacagggtattcagcttttagattagagtgcgatacttatccaatgattacagctactgatggcagctacactaaagaggagtatcgtcaatatcagattgacatgaaaaactatggaatcaatgtaattacggaaattgatacgccatatcatgctgaatgttttagaaatgttcctggagtaaaaatgcttaaagcaggggcgttggatattagagaacaatcctcttatgatgttattgaagctgttctggatgaatatttagatgggccaaatcctgttattcaaagtgataaattccatattggaacagatgaatatgataaatcatattcagagcaaatgcgtaaatggactgatcattttattaattatgttaatgataaaggatatgatacaagattatgggggtctttaggtagtcgaggatttaacggaacaacaccagtatcaaatgatgctacggttaacttatgggcaccatattgggcagatgttaaagaaacttataatgccggttatgatatcatcaatacttgtgggggatggttatatattgttcctggagctaatgctggttatccagatcgtttggatattgcttcattatatgataagttcgatgttaataatttctcaccaagtcgaaatgccggacaaggtactgcaatcatgccaattgctcatcctcaaactaaaggtggtcaattctgtgtatggaatgatatgacttcatatggtggaggatttacatggtttgatatttacgatcgttttattgatgcagttatgattactagtgaaaaaacttggtatggagaaaagacggatggtcaaactgctgctgagtttgttgaacgggctaataaattaaatagtgttgtacctggggcaaatccgggaagggtagtcgaatcaaaaggagaaaatattacagcaattgattttgaaacaattaaaaatggaaaagcagtagatacttcaggaaataattataatgctacattgaataacgcaattattgaaaaagctaatggtaataatattgctactgtaaatggagatgggtatgtggcattgccatataaatcaattggttatccttatacagtaatgatggatattaaattagacagcaatacatctgaaaatacccaaatatttagtggtgatgatggtgttatgtatgctaatatcgatggaactggaaaaataggatactcacgtagtggatataactttacttttgattatgaacttcccaaagatacttgggtaaatttagctttgacttgtgatcaaaagaatacgactttatacattaatggaaaagcgataacaacgggaattaatatgggcactgcaattaataaccgtaaagattctagtacatttgttttaccagttgaaaaaatcttaaataatgcaaaaggtagtgttgataacattaagatttataataaaacctttagtgcgacagaaatttctgatgaattaggttatattcaattagaaaatttagctttaaacaaaaatgcaactgcatcttccgtaaatccacttactcctaatttgacaccaaatttagcagttgatggagacaatactaaagttacaactaatcgctggtcaagcaaacgggcaacaggtgcaggaactaatgaaggcgatactgaatatggaacagttgaacaagatcttacggtagatttaggggcaaactataaagttgataaagtatttatttcttgggaaggtgcttatgcaactaaatacacgattcaaggctcattggatggtgtaaacttctttgacattaaagatattactaatggtactggaggagaaataactcataaagacttaggtgatgttgaaacacgttatataagaattgcttgtcatgatactaaaaatcgtaattggggatattcaatttatgaattagaagtatatcaaagtactaatgagggattaagagcattagttaaagaaggtcaagctgagctagcaaaatttgatgctggtaataaaaatggaaatattgctaaagatgattatgaagtatttgaacaaaaatttgaggattatttagcacttgcagacggtacagaaatttctactgaggaaattggcaagctattaaaagaagtgactgcgataatcaactcaatagaagatagtgtgatttattcaaaaaacgaattaaatgaactatatcaaaaagttagtttatatcaagaaaaagatttcacaaaggatagctttgttgattttaatacaaaattaactgctattaaaggattaattgataatgctgatgattatattaaagtaaatgaagcaatgggacaattacaaactttagatagtagtttagttaaattggatcgaagtaaattaaaaacagctattgaaagttatgataattttcaagaaactgattatacaacgagttcatggcaaacgatgaaaacaattgttgatgctgctaagcttgttcatgaaaatgtaagtttaaatcaagtggatgtagataatgcgatagctgctcttaatgaaattaatttagaaaaacgaggaaatactaaagaattagcgaaattattaaaagaatacgatgaagctgattatacaataagtacatgggcagaatttgcaggagtatatcaggcagcaaatgcaatggtagtcgataatagtgatgttaaccaagaacaagtagatgcaatggttgcattagttcgagaggctgcgatgaaacttctagaattaggtaattcaaaagaccttgaaaaagttatcaataaaataactgaagcgataaaagatctagatcaagctaattatgatcaagattcatggaataaacttcaaacaatgattaaggcagcaaaagaattattagatagtaaagatgtatctcaggcggaatttgatgctatgttagattcattaaatcaagtttatgatgctttaaaaccaatagaagtaaaacctggtgaggaaacggaaacaccaactaacaaaccagtaactgatacaagtgataaatctgtaaaaacaggtgatgatgttaatttatttggttatgcaggattattaggaatagctctaatgggattaatttgtcgtaaaaaatttgattaattaaaaacagtatttttgtggtgaccctctataaagtgatatgtgtccagaattctagatatctatcactttagggggtttttatatggaacattgtgccatgtttatatcttttatacgaaacattgtaccgtaattgtatagacacatttcttttatgtataaatagtgctatattaaaaatatagcaaaggattgttactttcagtaggcaagaccgaaaaagcaagatgctttttagtcttgtctttttttactaaaaacatctggcttcaaaaaaaggagggacatgcacagagggaaaataagtaagatttttattaatcaaagaaagggaagaattatggaaaagatattaaggaaaggttttatttcattattatcactcttgatggtatttactacatttaaccaacttattacaaatgtagctgctgaacaagagtatgaaaatatcgcattggataaagtggttgtggcgagtagtgctattgccggcaatgaggggagcaatgcagttgatggtaagatagatactaaatgggaagtaggtaatattagtacaaacccaagtattatagttgatttagggaaagaggaaagttttgaaaaaattacattaaagtgggctagtaattttgcatttcgttataaactatatgtggctaaggccgaccaaaaatatggacaagtcctattccacgaagagggtactggtggcgatgaagaatgggaaatggaagaaaatacaattgcccgctatgtgaaaattgaactgattgaagctaagagcggagaaagtacgattggtttaaaagaattagaagttttaagagttaagaaggatactagtaatgatccagttaatattgctttaaataaaccagcatatgcttctggcaatgaagctaatttggatcgtcttggaccaggtggagcctttgatggtaaatacagtaatgattataatgaacgctggtcaagtggaaatattactaagagtccccaatggatctatgttgatttagaagcagaaatgacattttcatcaatacatattttttgggaaaatgcttttgcgacaaaatatgtattgcaatattctaatgatgttggaactgataaaaattggataacatttgtaaatgtagatgatggtaagggaagttgggaaaaatttgattttgatccaattacagctcggtttgttcgtttatatgctacagcaagtaatggtgttggtagtgctaaaccgatttctatttgggaaatggaaatttatgaagaagtaaataatagtcttacagttgatgatattgccaaagattttacaatcgcaacaattacttcaaatatggataagatgccagtatatcattatgataatgataatattgtagcagaaattttttgtagtgatactgactttgtagttgaagataatggaatgattcataagccattggtagataaggaagtgttagttacttatattattaaagataaaagaactaatgcaactaaggaaatgaaaaatattccagttataattccagggcaaaattcagttgctttagatagtaatcctgtccctactacagttccaacgattcaagaatggaatggagcaacaggaacttatcaattaactaataattctagaattattgttcaagatgaaagtttatataaagcagctcaaattactaaagatgatattaaggatttatttggattagaattagaaattagtaatacaacagtaaaaaaaggagatattttattaactaaagaaaatgcggataccactattggtgatcagggatatacattagaaattggggatagtattacaattaagtcaacaacttatcaaggtattttctttggaacacgcagtgttttacaagcattagttgcaagtggggatgcactgacaattaataaaggtgaagcacgagattatgctaaatatgaatatcgtaaattcatgttggatgttgcccgtaaatatatgccaatgtggtatttaaaagattttgttaaatatgcatcttggtacaagttcacagatattcaagtacatttaaatgatacttcatacaacggtcattcgcgttttagattggagtcagatattccaggattaacggcaacagatggttattatacaaaaggtgagtatcgtgatttccaatattatgctgaggattatggaattagaattgtttctgagttcgatactccagcacattcagcagtgtttattgacaataattctgaattaggatttgatggaacacatttagatatacgcttaaattctgataaaaaagaaacagtgtataaatttattgctgatctatatgaagaatatatggggggagataatccggtttttgtaaccgatgcatttaatgtagggcttgatgagtacaatagtgcatacaaggaagatatgacccagtatactcaatacgtaatggatcttgtttataataaatatggtaaaacgccaatggcatgggcttctatgggatgtgtagattctgataaaacaaaaataccagattatccaattatggatgcttgggcaaattatgcaatcagtttaaaatcattatttaatcaggattataaattaattaacgcaactaataagtatggttatattgttcctggcgggaataatggttatccagattttgcgaaagaagaagaaatgtacaataacttaagtgctggaaaatttagagataaaatgggcgctggagttgatgttgctgaaggacatccaaaaattgttgggggttcgatttcattatggaatgaccgaggaatctttaatgggatttctgtttatgatgtttttgcaagaacacaaagtatcttaccaatatatgctcaaaccttttggtacggtaaagataatgacaagtcatatgaccaatttaaagctgaggtcaatactttaggtactggtccaaatgttgagatggataaagaaattagcagtaaaacagaaaaagtatatgactttgatatggaaaacacttcaaaacaaggggataatttagtcattaaagataattctggaaatggttatgatgctactgcaatcaaagcaacagttgaaacaactgatgaaggtcaggcattgaaattaaatggtgatggttatctacaaatgcagcatagtgcattgaaatggccgtatactttagcttttgatttaaaaatcgatgaatcacaaacaggcgatattgtattatttgaagaaacaatgccaatagaagaatgtaatcagtggattgatacaaagtatcaaacaagaaaaatctatttaaaagaaattgatggtaaatacaagctgatgtacgatcgtgatagttatcattatgagcataatatagaacttgaaaagggaaaattatatcaattagcttttacttctgataaaaaatatactaatgtttatctagatggagtagttaaatcaacgatcaatggaccaattcttaccaattcggggaataagtggtatgattcagcttcaatcaatttaccactacaaaagattggacaaaatttagtaggaacattagataatattaaagtttataatcgtttattgaataatgaagaaattaaaaatctttatgatacaggaatagatgttattcatgaaaatattgctttgaataaagaagcaacagcttcaagcagctatactgattatcaaacaccaaataaggcatttgatggaatcattaatcaaagtgctagtggtcctgagcaatcacgctgggcgtcagcacgtacgcatgatcagtggatccaggtagatttaaataaagtttataaagttgatcaaatcaagattacctgggaagatgcttatggagtggactatgaattaaaaggctcagttaacggtaaagactggtttacgatcaaaaatgtaactggtaatgtagctaaggaaaataatcatactggattaggtgatattgaagcacgttatattaaattaattggtacaaaagctgctaataacgctaagtatggatattctatttatgaaattgaagtatatgaaaatcctaaaaatgatttacttagaacaattagtcaagttaaagataaattaagtgaaatgaatgtgggtaatttccacggtcaaatcaaagaagaagcttatcaaactttcacggcttatttaaccaatcttgaaaatgaagtggtaggaaaagaaagtatcagtgaagaagaaatgcttaagttcaaagaagaattgtctaaaaaatacacaaatttaaagaaacaggttgtaagagttgataaaggtgctttagaaacagtgcttgaagtggcggagagtaaactggcagaagggtacagtgaagcaaatagtacagtttcaagctggcaaagtttcatacaaaacaaaaaagcagctgaagcaatggctgatagaatggatattactcaaagcgatgttgataagatggtatctgaactgcaaacagcattagataatttaacatttagggcgttggaatcgtcatttaatgaactggttgcactgattgatgaagttactaagatggaaactgattattctgcagaaatgtttaaggttatgaaaggatatcttgatcaagcaaatgccttagttgcactaggagcaggagaagtagttgaaaaagatgttcaagccaatctaacaaatcttgcaaatgaaaaagccattctgattagttaccgggaattaaaggtaagcgttgaagttgcaaaagagattttggataaagaagcagtaaatcttcggccagctactttgaaagtattgcaagatgcttatgaagcaggaagaaaactaatagatgataacagtaaggaacttatagttttacaaaatgcaaaacaagaaatcaatgaagcgattgaaggacttttagaaatagtagagcgcaaggatttagataaattgattgaacaggttaaagatttaaaagaagaagattatactgaagaatcatggaaaacgtttaaaaatggttatgaaagggccgtcacagttaatcaggatcttgacgctaatgaaggtgctattcaaaatgcctacgatgaattactaagagctttcaatgaattaaagcaagttgttaataaagataatttactactccaaattgaattggcaaaacaagttcttgctaacaaagataaatatgatattgagttagtcaaggaattagaagaattattaagtcaggcagttgcactgattgctaatgatgttagcagtgaagatgttaataaaatgagtgatgctctattaacaaaaatcgaagctgttaaagctagtcaaaaagaggaaccgaaggttgaggaacagccagggactgaggtatcagacaaaacaaagaaaaatgctaaaacaggtgatgaaacaatgctctttgaatttgcaatgatatcattagttgcacttttagctgtggttagattaagaaagaagagttaattagttaaagggtcatgttcaaaagcgaatatgacccttaattatacaattaatcgattttattaatcgataatgatataatattgtagagataaatgtggggtgtatgagatgaaaattaaaaactttaaaagaatctatgtcgacatcgtgatatcatgtttgatcattgctgttgtcgcaactttttttgcttttaaatctcaaacaatttcacaagaacaggttctaaatacgttatcagaaatttctagtcaaagtgtaaatgtgattgataaagagattcaaaaaaatgttgcagttttagcaaatttatcaatttatattagccaagaggatgcttttgatcccgtcaaaattattaacaaaataaaaaaagtgaatgaaattaataattttaaacgaattggaataattgatgagagaggacagtcctatacgacagatgataataatattttattaaatgaacagcaaatgacccgttttaataaagcgatgaatggtgaagtatcaattactgatacattgccggatttgattgatggtgaagaagttagtgtttatacgttacccataacctttgataatgatcaacattgtgtactttttggagcttatgcatcacggtattataaagagactttatcggtttctacatttgatggtttaggatatagttttattattaaggaaaatggtgataaaattgtagattcttctaacaagacaagcattaaattttctaacttttttgatgatattggggcaatttcaaaagaaaataaagaaaagctggaaaatttaaaacataatattaaaaatgaaaaaagtggatttttagagtatgatcggacagatgaagctagatatttgtattaccaaaagcttgatgttaatgattggtatttgttgagtgttattcctgcttcggtggttgataataatattaatggaatgctttttttaggttatatgatgctaggctgctgtttattaggaattttatatttaattactcgaattgtattgatgtatcgtaataatcaaaaacgtttagaagaagtggcactagttgatgaggtaacgggatgcggttcatatacacgctttagactggctggtggtgatattttaaaatctaccaaatctaaatatacaatggtttatttcaatattttgaagtttcagtatattaatgatttatatggctatgatgagggtaatcttattttagtgaaaatagctaaaattttaaataatttgttgcaggaaaaagagttttgtgcacgaattcaagctgatcactttgttgctttattacaatatgactctgttacacagttgaaaaagcgggcagagtatatgattaaaaatatggaaaatgcaattaacagtaatgatgaagcagcttatcgaattaaaatgattgttgggatttatttaattgaaaattataatgatcgaattgaatcaatggttgatcgagccgcaactgtgattcgtgatgaaaatcgccatgaactagagaattgtaatttttacaatgataacattcgtcaaagaatgtataaaaataaagagttggaagacttgtttgaggaagccttgcataatcatgaatttgaagtttattttcagccaaaatatagtacaaagaaaaaaagactttatggagctgaggcgctggttaggtggaaaagcagtaaactaggatcgataagtcctggagaatttataccggttttagaacgcagcagtaatattattgaattggatgagtatgtttttgtaattacgtgtaagcagattcgtaaatggcttgatgatggtcttgaggttgctcctatagcggtaaatgtttcgcaattacatttatatcgtcaagattttgttgaaagttatctaaaagtaattgatgcttatcagataccctataatttaattgaattagagatgacggaaacaagtttgtttgataatcgtgatattttaaaagatattctcaataaatttaggaaattaaagattacagtatctatggatgattttggttcaggttattcttcaatcatgatgctcgaatcaatgccaatcgattgtttaaaaattgataaaacaatgattgatgatttggaggtcaattcaaaggctaaagaaattttgaaatcgattattagtttagctcaatctttagggctagtcgttgtagctgaaggtgtagaacaggctggacagtatgaggaattaattagaatgaaggtagattatattcagggatattattgtgctcgaccgctgccattagatgagtatgagaaaattttaaaattaaaaaagtaaaaagattcaattattttaacgtaattttttgaatttttttagaaatttctaagttatgattattgaaacttaaaaagtcttaataatcataaaatctcattgatttttagctggaaaaagcataagatagttcgtgaatatagaaaaatggatttaaagatgggagagggtgatagcatgaaaaatcgaattatatcagttgttttaagcttctttgtcatagtaaatataattttaattgcttgtgccttcaatgttacccccctaacgatcaaaagagatacatttgtttatgaatatggtagtgaaatatcgactaagccgcaagattatattaatgctaatgaggcaattttatcacaagttattttgaatttttcgaatttaaaaaatgaaattggtgaatataaagtatctgctacatatttaggtgttgaatatcctttttatataaagatagttgatacaactaaaccagttgtaacattaaaagcatctacgtttaatgttcatttaaatactgaagtatatgcaattgatttaattgaaaaggttgaggataattcagatatagctgcatattttattgatgaaaatggtgagaagtcaacacataaagtgttcactgaaaaaggttcttatgttgaaaggataattgttgaagatcaggcaggaaatcaatctgccagtttacgagttaaaatagtagctggacaaaatggtaataatcctactcttacaggaattgatgatattgaggtattaaaaaatagtaaatttaatcctcttgatggagtgaaagctactgatggtagtgggaatgatattactaagaatataaaaattttaaaaaataatgttaatacagataaagttggtgattatgaagtaatttattcaattacaaatgataaaggacataatctccaaagaacaagacgcgttagtgtcattaaaacagaaaaggcaggagaatagatgataaccaatgctattattatcatatcgattataatctttattttaattaattttattgataagagtaattatgataaaacctctttagcgattaaatacggggctttttatatgccgcgaattgaagtaaaaaaagaatattggcgttttattaccgctaatttcgttcatatcgatattatgcatatttttatgaatgtatattgtatttataatcttggccatttttttgaatacttattaggaacgggcgcatatttatatctaatcttcataagctgtcttgctactagcggagcttgttattatcatggaaaaaaatatgcttatgcatataatactgtgactttaggagctagtgggattttttatggttatttaggtgcaatgattgctttaggaatacttgtaggcggttattttgattatatgttgcaacaatatatatatgtgattttaattaatgtagcttttacatttttcaatcgtcaggtatcaaaggcgggacattttggaggtctggcaggtggctttttagcaactgcaatgttgattggttgtggtgtatggcacttttagttgatggtgatgcttgtcctgatttaccaacaattagagatttagcttggaaatatcaggttgaaatgacggtttttgttgattatgctcattttatacaggatgattattttagaactattctatgtgaagtgggaagtgacagtgttgatctagttttattgaaacaggttcaagcaaatgatcttgttattactcaggactatggtctagcaagtttagtgttatcaaaaggggctaaagttttgcatatttcaggaaaagtaattgatgataataatattgaagaattattaatgagtcgttatgtatcagctaaacaacgaaaaagtggtaagcggacacgtggaccagctaaaagaactgatgaagtaagaaatcagtttttaaaacaattagataaaatattgatacaggcatgaattattctgatgatttgtgcctttttattttaatgttcatcaatttaatgtataattaatatgataatattgtgatgtaaaaaggggtggtttgatgaaaacactaaaaacaattttagtattgttaattatgtcaatgctgatcaatatcatcccaattaaagcagcctcccgaactgttaaagttgcttatccaattcaatctggattaacagagatagatgaagatggattatattccggctatacttatgaatatttaaaagaaatctctcgatttacgaattggaacttagaatttgtacgcttagaaggcacagtaaatgagcagctgtcaagcgctatggaaaaggtcaaaacaggcgagattgatttaatgggtgggatgctctatattgataccttaatcaatgattatgattattcggcaaccaattatggcatgggaaatatggctatctatgttaattctaataatgctgaaatcaatgatactagtatatattctcttaagaatttaaatgttggagttgtttcaactaaaaaggaaactaatgttaatttaaaagattttggagatattaatggaattaatattaatcaaatattttttgataataccccagatttattaacatcattagagagaaatgaaatagatgctatggtattatcagatttatcaattgaagaaggtaattatcgggtcgtagcacgtttttcgcctcgtccattttattttgtaatgacaaaaggaaatcaagaactgatgtcagagctaaatgaagcgatgacacagttaaataaagaacagcctaattatatgagcaatcttcatgaacgttacttttctttagcgaaccgtaatttcattcttaccgaagctgagaaaggttttgttgcaaataattcaaaaattgatgttcttatattgggtgggaaagccccaatccagtattatgatgaaaaaaaaggcaaggttgtaggaattaccgttgatgtgcttaattatattggaaaactgagcggtttgaagtttaattatatttatgccaatgatattgatgaatataataagcagattgagacgaagaaaccaatgattattggtggggtgtataatagcaatccagaaaaatatattacgacgaaagcttatttagattcagcgatgacgctagtaactaataaaaatattaatgctaatgagctagacggtaaacaggcagcaatgatttatgattctgaagttgatagtgccgcagttggagatagtagtaacaaagttaattattatggaactcagttagaatgtatcaaagcggtagaaaacggcacagctgactatacgtatataaataatcatgttgccttgttttataatagtaattatgatttcaagaatattaatattattcctcaagggaatttaagaaatcaaggcagttattttgcaattaatacaggtgttgcggatgagcttttagatattatcaataaaggaattgatgtcgtatcttacagtaagattgaagaaattatatttactaatgccagtaccagtgaaaatgatgttactttctttgactatgttgaaaataatcaacttcaagtagctacttttacgcttatggcagttgccattattgtgctgtttttcttgatttggcgtaattatataaataaacgtaataatgaaaagattttaagtgagtataagcgttatcaacaaattagtgaattttctcatgattgctttgttgaatataatattgcaactgatacccttgttttaatgggaggtggagccaaactgctttcaaaggaaacgattattaaagattttttaaagagaccaatttctaataaagatactttagaaatgagtctacgtaatttgacggaatgtgagagtgaggagtttgttaaatttattgatgggaaaaaacgttggttaaagattaatttgcgtccgatttttgatttgaataataaaccgacacatattattggaaaggttattgatatccattctgaaaaagaagaacagttattatggcgggagctggctcaaaaagatagtttaacaaaaatttataattctgcagcttgtcgtgaaaaggcagaagagtttttacaaaataatacagcagcccaagttgctttgataattattgatattgataactttaaatatattaatgatacttatggacatttatgtggtgatattgtccttcaaaaaatagctcaggcattattggaagtgagccatcctttagatatctttggacgggttggtggagatgaatttttaacattaataaaatatcctaagagtattgaaaaagtagctgagtattgtcaaaatatgattaaatcaacttcaaaagtagaataccaggggacccatattattacaagtattagtgttggtgccgtagtttcgagtgtttcgttgtcttatgatgaattatatagattggcagatgatgctctttatcgtgtgaaaaacaatggtcgcaataattattgtattattgattatgataaagaaaataccagttcgtaaaagaactggtatttttatttaccgctgtcaccatagttttttaaaactcgagcactgggatcatcaacattacagttttcccaatctttatttggcatccaaaagtctttgacccattttgcttgccccggataaaacgattcaaaaatatcacggtataagagagattctttagtaaaaggtgttgcaaaagcatatttttctttagctttaataacatcttcatcagtatataaagtagctgcatattcttttaaataatcaaccattgaatgaccaacagcgtctgaaaatgcggccttttccctaaataaaatttcatcaggtaaataatcctgattttcaaaagcatgtcttaataaatattttcctttattatagatattcattttcttagctggatcaatactcattgaataatcaacaaaatcaatatctgcaaatggaacccgtccctctaaagcgtgagcagagatacaacgatcagctcttagaacatcatacatatataattctttaattcgcttttgtgcttctttttgaaattgtgatggatctggtgcaaaatcagtatatttgtagccaaataactcatcgcttacttcaccggttagaataacttttaaatcagttttttcatgaatatatttacataataaatacattgccatactggctctgatcgttgtgatatcataagtttctaaatgaaaaataacatctcttaaattttctaatagatcttccttggtcataattacttctgtatgatcagttcctaagtaatcagcaacttgtttagcatactttaaatcaataggatcagtatccataccgattgcaaaggttttgattggttgatcatttaaacgtgcggcaatcgcacaaaccaaggatgaatctaaaccaccgcttaataaatatccgattggagcatcgctttgcaatcttttttccactgctttttctaatttgaggcgtaaatttattgcaattgtttctaaatcatcgttattgatcgttttaggattacttaaatcattataacaaataaatttgccatcttcataataatgccctggtggaaatggcattatttcttggcataaaggaaataatccttttgcttctgaagcaaagcagatcttaccgtcttctttatgatatccatagaacatagggcgaattcccattggatcacgtgcagctaaaattttatcctttttggcatcatagattaccattgcaaattcggcatctaaaaatttacataatatctctatcccgtatttgtgatatagcggaatcagtacttcacagtcacttcctgacttaaaagtatagtccgtttctaacatagcttttaagctatgatagttataaacttcaccattgcagacaagaacacaatccttatagacaaaaggctgattaccttttgatgacaaatccataattgaaagacggttaaatccccaggttataccgttgttaatgcttacatgttgatgatcaggaccacgataagcagcctgatttaatgcatcattgaatacttgtaattctaattcactacttcctactactaaaaaaccgcacataatttgtttcccccttaaaattattgttgcgagaatataaaaactcgcctaaagaagcgagtaccgtataactagaaaaggaatttatagttacatggtacggaaaatacttcatagagtactcgatacccgccaatagtaacgttactggtaacgttctagcctacttgcataatgctttcggtagacagctcttaggtgttcttcataaactacttcactatcaggcttgcaccgttccctgattcgctaaagcttctgtagattactactctcctcgtcattgcttttaattactttatagtaattgaaaatagtatatattatttttttattaaatgcaataaaaaagcttcaatacgatagaaaaaattgcaaaataataaaaaaccatcatcagatggttttacaaacatcaatccattctgctttaatatagctagaaagttcatcaatcgttaattcaatagcactgttagaattgccgcaggcaggaaaaactgtttgaaatcgcttaagtgattcatcaagatagatagtaacatcaggattaacgccaaaagggcatactcccccaatatcatgaccgatgattggcaatacttcatcgcgtgcgagcatttttgctttggttttaaaggtttctttgtatttgcgattatcgattttaacatcaccagcagtaacaatcaaaatcgcgcgttcgttgattttaaaagataatgtcttagcaatacgttcaggcgcacagtttaaagctttagcagcaagttcaacagtagcactagaaacatcgaattcgataatatcttgttcccggttgaattgtttcaaataatttttagcttgttgtagtgacatgatgcaacctccttataaattaaagcaattctaccataattattaatattttcaagcaaaaatattgagatgataataagactaatttattattgatttgagactaaaataggttattttagggttataatactagtatcaaatattatctttaaatatatttgacaaaataactatcttttaataaactttgattatattgagaggtagaaaaatgacgtataaattaattgcattagatttagatggtactttgaagagtactgataaacaaatcttaccaaagacaaaagccatcttgcaggagctggcaaaaagaggtgtagtgattgttttggcttcaggtcgtccaactgctggattgtatgcagaagctaatgagctggaattagataaaacaggtggctatttactatcatttaatggtgctaaggttgttgattataaaacaaaagaaatcatatatcaaaaagtgtacgatgctaaaacggcacatcaggtttatgagcgagcgaaacagtataatttggcggtaatgacttatactgatgaattgattcttacagaagatgaaaccgatgagtatgtttgtattgaaggcgatattaatcatatgccaatcaaacatattgataattttaaagatgcagtgaatttttctgtaaataaagtcttattaacggcaaagcctgaatatgctgagacaatacttgatgagtttaaggcaccatatggtgattctttaagtatttatcgttcagcaccatttttcattgaagtgatggcgcaaggaattgataaagcggcttcattgcaggctttaattgagcgtttaggaattaaacgagatgaagtaattagctttggtgatggttataatgatttgagtatgattgagtttgcaaaattcggtgtagcaatggccaatgcagttgatgaagtaaaaaagagagcggcttatatcactttatcaaatgatgaagaaggaatttatgagtgcttaaagatgttaagtgaaaagggtgaaatttaatgttaccaaatgatattaatatgctagtgagttttttaaatactaaattacgtgatgatgatatgtcattggcacaaatattagaaattaatgatgctaatgaaattgaaatcatggaattattggatgtgaatggatattattttgatgaaaaaattaaccaaataaaaattaaataaggcagatcaatatgatttgtctttttttatgattatatttttaatcatctgatattattaaagacaatcttttactttttaatgataaatgctataatgtaatttaattaagggggacatgtcaaatgttgaagttagaagattttaaagccgcaaagcaaagagttgatgaagtaattttagagacacatttaattcatagcgatgctttttcagctgaatgtggtaatgatgtttatatcaaaccagaaaatttacaaaaaactggtgctttcaagattagaggtgcctataataagatcgtgaaattagatgatgaagctaaaaagcatggattaattgcatcttcagcgggaaatcatgctcaaggggttgcttatgcagctaataaactaggagttaaggcaactattgtaatgcctagtcatacaccattgatcaaggttgaggcaacaaaggcccatggtgctgatgtggttttagctggcgaggtttatgatgatgcttacgctaaggcagttgaactacaagaaagtgaagggtatacttttgtccatccgtttgatgatgaagatgttatggaaggacaagggacgatcgcattggagattcttgaagaattaccagatgctgatatgattttagtaccaattggtggcggtggcttaatttcggggattgctgcagctgctaaattaattaaacccgatattcaaatcattggggttgaacctgaaggagcggcaagtgcttctgcagctattcaagaggatcaggtagttttattgaatgaggttaatacgattgccgatggtacagctgtgcaacaaattggctctaaaacgtttaaatatattaaagaatatgttgatgatattgttttggtcaatgactatgaattgatggaagcattcttgttattagttgaaaaacataagctggtagctgaaggttctgggattttagctttagcaggattaaagaagctaaaaactaaagggaagaaagttgtatcattgatcagtggtggaaatattgatgtgttaactatttcgtctatgattaataaaggacttatttcaagaggacgaatttttactttctctgttcaattacctgataaaccagggcagttggaattagtatcgaaggttttaaatcaatgtaatgccaatgtaattggtgttgaccataatcagtttaaaaattttgctcgtttttctgaagtagaattaagagtaacagttgagactaatggtaatgcgcacattcaaatgattattgatgagtttaataaacttgggtatacaattactaaaataaattaatatttttacataagggtaggcagcagcttatcctttttatcatatttatttttataatatgaaaattagaaatattgaagggattaggcttttataatgaagatatatgatttatttatatgaataaaaggagagtgatttaataatggagaaatggtggcaaaaggaagtagtttatcagatttatcctaaaagctttaaagatagcaatggtgatggaattggtgatttacaaggaattattgagaaattagattattttagtgatttaggggtaacgagcctatggttatgtccaatttatgcttcaccaatggatgataatggttatgatattagtgattattatgcaattaatcctatgtttggaacaatggaagatttggatgagttaattaaaaaaggaaaagcacgaggaattaagataattatggatttagttgtaaatcacacctctgatgaacacccatggtttaaagcagcaatcgctgatccgacgagtaagtatcggaattattatatatttaaacatggaaaagatggtcgtgcgccaactaattggcggagtattttcggtggctcagtatggcaaaaagttactgaagatgaatattattttcatgctttttcaaaaaagcaaccatgcttaaattgggaaaaccctgtattacggcaagaaatttatcaaatgatcaactggtggttagataaaggaattgcaggatttagggtggatgccattaattttattaaaaaggatcaacgttatcaagatggtgagcctgatggtgaagatggattagtgtcttgtatcccttttgcgcgtaatcagccaggaattgaagttttctttaaggaattaaaggagaatacgtttgctaaacatgactgtatgacaatttctgaggcttatggggtatcatatgataaattaggtatctatattggtgaaaatggatgttttgacagtatgttcgactttaattactctaattttgatattggagataatgaggaatggtttattcgtaaagactggactgtaaaacaatttagagatttactatttacttcacaagtcgaagtaaataaagtaggctgggtaggaactttcctagaaaatcatgatcagccgcgttctttagataagttgattgtaaataaagcagatcatggttattatagtgctacaatgattgcttcaatgtatttctttttaagaggggttccctatatttatcaaggagaagaattaggaatggcaaattgtgttcggcgatctattgatgattttgatgatattagttcacatggccaatatcaaagaatgcttgaagaaggatttagtgaaagtgaggcattggctctagttaataaacgcagtcgtgataattctagaactccaatgccgtttgatgacagtcaatatgctgggttttctgatgttgaaccgtggttagcgttaaatgaaagttatccagttataaatgttaaggcacagtttaatgatccggattcagtttatagtttttataagaaaatgatctatttaagacaacaaagtgtttatagtaatactttaacttttggaagctttattcccgatgaatgtgaaaatgataatttgattgtctaccagagaagttatcaaggacaacttattgtcaatgtatgtaatttttcgaatcaagagcagccatttatttgtgctaaagagcttattttaaataattataaagaatatgatggtaaagtattgaaaccatatcaaacgattatgtatcttgaagaaaataaataaaatatgataaaagagatttcattcaatgagatctcttttttgttggagggaaatgtgagatattattgtcgttctccttgtcagagtgtcattatattagtgatataaatcaacaaaggagcagaaagatgaaaagaaaattaaatcaatatattcgaaagtcactgttagttgcagtgacttttattttggtgttttgtaatgctgtaacttatgtcaatggacagcaatatcaaattagtgcaggtgagaaaattaaatatcctagctggtttgacagtagtggaacctggtcaacacgaatgtatactgtagatggaaaaatagcatattgtttagaagcaagcaaacattcaccaggtaatggaactgtaggagaaggaagttatgtagataatgaaaatcttcaaaaagtactttattatggctatgggggtcctgctgatacactatcaacagatggtgtaactagtgttgaaatggcatatctgttaactcatattgccgcaagctattattatgctggagatcttcatggtgttgacttggaaaaactacgtggctggggctgggcagaatggatcgaagcaatccctaatcgtcctgcaattcctaaaggagagattggattttcaaaaaatagtttgaaaatgtatcaaaaagatggtaggcagcggagtgaagaaattacggtaattggtgatgctgatgctactttaacgatggttttagacaaagacatggaattacataatttaacgacaaatcaaacagttactgggacggtacaattaagtagtggtcaaaaattctatttatcgtctccattaaccaaacgagacaattataactggtcgagtggttctttgatgggaacaacgaatagttattatcgacctttagttttaacgattgacgatgaaacccaaacgattggaacaatggttttagggaatggagaaaccaaaccaactagtttgcaagtagaatatttaccagtggggagtttgaaattaatcaaaacaaatgaggataaacagatgctagatggggcggtatttaatttgaaggggaaaaataatgattataatcaagatcatgtggttaaaaatggcgtattacaaatagataatttattagttggagattatattttaacggaaattaagacaccagccgatcatgatagtcttaataaggaatacactgttacgattaaaagtaatgaagtgactacaaaaacaattgtcaatgaattgataccagtcggtaaattaataatcaataagaaactagaaggacatttagatgatttatctggaattgaatttaagataactgctaaggaggacattaaagatataattacagggacagttctttatcgagctggtatgccaattggtcaaaatcaaggaatttatattacagatcaaaatggacaaattattattgataagttaccgatgggaagttatcttattagtgaggtaaagactttaccgggatatgtatttgatgatactgtttatgaagtagcttttaataaagaagatagggttaccaaagaataccagtatactttaaatgtagaaaataaattaacacaaacaacaatttctaaaattgacgctctaactaagcaattattaccaggagcaacattagaactatatttaaaggatggagaatcattgagtttgattgaacaatgggtatcaactgatgatgcacatttaatcaaggggctgttagttgattgtgaatatgttttaaaagaggtcaaggctccagccggttatacacttgcgccagaacttacgtttaaagttgagaacagtgagagtataaaagaaatagtatttgaaaatcagcatattcctgtggtaccaactggtgatataagcaattatagtggttatgctggaattgcattaataagctttatattctttttaatttttacaaaacagaaacgtagaatattataaatatgacgaaagccccagttaatggggcttttaattaagctattaaaatgaaattattaccaatatttattgatagtcatatttaaatcaacgttaccattgattcctctaatttgaccagtttcactatattgtaaaatatgatattcttcttctaatactggagtatcattataacgtgctttccatttaatgtaagaatctagttttttatcagttaatttagttgtccaccagtgatgattagcatagattccttttttattttgattttgaatgttatctaaaaaagttgtagctacgattgttaattgatcatttgttaaagccccttgaaaagtttcgtcttctaaatcaataaaaaccccaagttcgggaactcttccatctagtaaatgattaacatactcagcctctttttttgcttgagcagcttcagtggctaaagaataataatatacaccgtaaggaatatttaaattttgacattgcttgatattttgttcaaaaagcggatcaactttggttttggtaccatcagttagagaagtatagccgcaacggataatcacaaaatcaatttcttgacgagctaactgcaaattcacattattattccatttagaaatatcaatgccaatatattggccgtctttagctaatcgatcattatgattaaagactaatataccagtaacaattaaactaaatgataaagcagatacgatgattttgattagattatgttgctttttaaatcgcttaaataaaaatggcagtaaacaaaatatcataattagtaaaataacgatactatgggtcagatactttggtaaatattgtttataatataatgaacatgaaaaaagaagggtaccagcaataaaaagaaaaataatatttttttgactaaaaattttatttttagttttctttttcatgatatcacctcgacaactaattctaacataattaaaaatagttgtcgattgatgcttattgatgattttgtttttcaagttcttcaagaatttgatctaatttattatgaagatcctgaataatgatttcagttttcaaatttactttataatcattttcgtttctttgacgatctttttgctcttgacgattttgcgacatcataataataggtgcttgaatcgcagcaatacatgacaaaatcagatttaaaagaataaagggataaggatcgaggctatctttagcaaggatattataaatcatccaggaaattagtaatataataaaaataatgataaaagtccaactaccaccaagatgagcaattttatcagcaattttttgtcctagtgtttcatccttaccatcaggtaaagcaactgttttttcaagaacaagatgaattatttcttcatcctgcatatcatcacgaacattttcaatgatttcatttattattttagtgtgtgttaaatttttcattaaaaccatccttttatatagtatttacagcttgttttgttttaaacgcaataactagattttaaataaaaatatggattttgaagaaggtttcttacaatgataactaattataaatttgttgaatagtgtcatttagttttgtatactaatatggataaagttatgaaggagtgattatgatgtttaaagtatttggtgaacgcattgttaagactattactgatcattttcaattcttttatatttctattttttataattaacatatcatttacttgatatgtttttttgtgaaattaatcaagattatacggaggaacaaaaatgccaaaaagagaagatattaatacagtattagtaattggttcaggtccaattattattggtcaagcttgtgaatttgattattcaggaactcaagcgtgtaaagctttaagagggttaggttataagatcgtgttagtgaactcaaatcctgcaacgatcatgacagatccggaaactgctgatgttacttatattgaaccattaaatgtagaacgattaacacagatcattgaaaaagaaagaccagatgcgttacttcctaacttaggtgggcaatcagcattaaacttatgttctgaattaaatgaggctggtgttttagaaaaatataacgttcaagtattaggagttcaagttgatgcgattgaacgtggtgaagaccgtttagaatttaaaaaagaaatggataaattaggcattgaaatggctcgtagtgaggtttcaacaactgttgaagaagccttagcaattgctgaacggttaggttatccagtagttgtgcgccctgcttatactatgggtggtgccggtggtggactggtatataacgttgaagaattaaaaacagttgtatctcgggggttacaagctagtttagttggtcaatgtttaatcgaagaatctattttaggttgggaagaattagaagttgaagttgttcgtgatgctaacaacaacatgatcacagtatgtttcattgaaaatattgatccattaggagttcatactggagattcattctgtagcgctccaatgttaacaattagccaagaagtgcaagatcgtttaaaagaccaagcatttagaattgttgaatcaattggtgtaattggagggacaaatgttcaatttgctcatgatccagaaactgatcgaatcgttgttattgaaattaatccaagaacatctcgttcatcagctttagcatcaaaagcaacaggattcccaattgctttagtttcagcaatgttagcggctggtttgactatggaagatattccttgtggtaaatatggaactttagataaatatgtacctgatggtgattatgttgtaatcaagtttgcacgttgggcatttgaaaaattcaaaggggctgaagataaacttggtactcaaatgaaagctgttggggaagttatgagtatcggcaaaacttataaagaagctttccaaaaagcaattcgttcattggaaattggacgttatggcttagggtatgctaaaaacttcaataagttatctaaagaagaattattacatatgttaactgttccaactagcgaaagacaattcattatgtatgaagcgttaagaaagggagcaacagttgaagaattatttgaactaacacaaatcaaacattatttcattgaacaaatgaaagaattagttgaagaagaagaaaatataaaatcatacgaaggtaaagaattaccggctgaagtactaaaacaagcaaaacaagatggattctcagataaatatttaagtcaaattttgaatgttgaggaaaatgtaattagagaagaaagattagctaataatattaatcaagcatgggaaccagtacacgtaagtggaacaaaggatagtgcttattattattcaacatataatgctgaagataatagcgacattcatcacgataaaaagaaaattatgattttaggtggtggacctaatcgtattggacaaggaattgaatttgactattgctgtgttcatgctgctttagcattaaagaaattaggatttgaaacaattattgttaactgtaaccctgaaactgtatcaactgactatgatacatctgataaattatactttgaaccactaacattagaagatgttttaagtattcatgaaaaagaaaaaccagtaggtgtaattgcacaatttggtggacagacaccacttaacttagctgctcaattaaagaaaaatggtgtgaatattttaggaacaacaccagaaactattgatatggcagaagatcgtgacttatttaatgcaatgatggaaaaattagaaattccaatgcctgaatctggaatggcagtaaatgttgaagaagcattagaaattgctaaaagaatcggctatccattaatggtaagaccttcttatgttttaggtggtcgtggaatggaagttgtttatgatgatgaaagtcttgaacaatatatgaaagcagctgttggggtaactcctgatcgcccaatcttaatcgaccgcttcttaaataatgctatggaatgtgaagctgatgcaatcagtgacggtgaaactgtttttgttcctgcggttatggaacatatcgaattagctggtatccactcaggtgattcagcatgtatcttaccctctaaacatattcctatccgtcatttagaaacaattaaagaatatacaaagaaaattgctaaagaaatgaatgttcgtggtttaatgaatatgcaatatgcaattgctgatgataaagtatatgtattagaagccaatccaagagcttcaagaacagtaccactagtttcaaaggtatgtaatattaatatggtaaaaattgcgacagatattgttactcgtgaattgactgggcgtccttcaccagtaccaactttaacagaaaagaaaattcctcatattggagttaaacaagcagttttcccattcaatatgttcccggaagtagatcctgttttaggacctgaaatgcgttcaactggagaggtattaggaattgccagttcatatggagcagctttatataaagctgaagaaggggcgaaaacaattttaccaactgaaggaaaagttttgatcagtgttagtgacttagacaaaccagaagttgttgagcttgcacaaggatattatgatgctggatttactattgtagcaacagggaatacttataacttgatcaaagaaagtggtattccagtagaaaaaatcaaaaaaattcatgaaggtcgtccaaatattagtgatgctttaactaatggtgaattagcaatgatcattaatacacctcatggtaaacaaagtgctcatgatgatagttatattcgtaaagctgcaattaaaatgagaattccatatatgactaatattgctgctgctaaagcatcattagaaggaattatggaaatgaaaattcatggtagtcatgaagttaaatctttacaagagtatcatttagcaattaaataaaatttaaatttaagctattcccaccaaagtagataaatgagataatttcactaaatctatggaggtgggattttattgtgtttgtatcaatgattttttattattaggcttgaaaatattaatctatatcaataaatttgactcgtgataataaaaaagtataaaaatatcttgaatattcaaatgatttctactatactatacaagaataagaaaggaatgaggcatatgttggtgttttttaaagaattagtaagtgaaaaatttgatattatgaactcatttttatatttttattgttattaaacatatcagttatattgatatgtttttttatagtaattaaggaggatgaatgatgaaagcatacttaattttagaagatggcagtgtatttgaaggaacaagtattggtgcagttaaagaagtagttagtgagtttgtatttaatacttcgatgacaggatatttagaagtgttaacagatccttcttatgctggtcagtcagtcgtaatgacttatccattaattgggaattatggggtttgtttagaagaccaagagtcaagtaaaccacatgtagagggatttattgtaaatgaactagctagattgggaagtaattttagaaaaaatattgatttagaggaatacctaatccaacatgatattcctgggattcaaggaattgatactcgaaatctaacgaaaattattcgtaatattggatgtatgaatggaatgataacaacaactaaatatgaaaatcttgatgaagtaatgaaacggattcatgctttcaaagtaactggagttgtggaacaaactacatgtaaagagtcttatacaattggtactggagataaaagagttgctttattagattatggagcaaaagctaacattgctaaaagtttagtgaaacgtggatgtcaagttacagtctatcctgccagtacgccagcgtcagttattctaaaagaaaagtatgatggaatcatgctttcaaatggtcctggagatcctgaggaaaatgttcaaattattgaagaaatcaagctgcttgcaagtagtcaaacaccgatttttgcgatttgtttaggacatcagttaatggctttagcccatggtttcaaaactgaaaagatgaagtatggccatcatggtgctaatcatccggttaaagatttagaaactggtcgagtatatatttctactcagaatcataattttgtgattaaagaagattcaattgattcagcagtagcaaaaccatggtttatcaatgtaaatgataagacaatcgaaggtgttacttatcttaaggaaaatattaaaacagtacaatttcaccctgaagcatgtgctggtccattggatactgatgctttatttgaagaatttataaagatgatggagggaaaatagaatgccaaaagatagtagaataaaaaaagtattagtaattggttcgggaccaattattattggtcaagcagcagaatttgattatgctggaactcaagcttgtcgggcattaaaagaagaagggattgaagtagttttaatcaactctaaccctgcaacaatcatgactgataaggatattgctgataaggtttatattgagcccttaaccgtaccggttgttaaaagtttaataattaaagaacagccagacagtattttgccaaccctgggtggtcaaaatgctttgaatattgcgatggcattagctgatgaaggttttttagaagaacataatgttcaaacgattgggacttcaactaatacgattaaattagccgaagatcgcttagagtttaaaaccctaatggaaaatattaatgaaccatgtgcagcctcattagttgttaatcatgttgatgatgctttagagtttgctaaaaagattggttatccagttgtagtacgtcctgcttatactttaggtggaacgggaggcggaatcgcttatgatgaaacagaattacatgatatctgttcaaatggattaaggttatcacgagttagtcaatgtttaattgaaaggtgtattgccggatggaaagaaattgagtatgaagtaatgcgtgatggtgctggaaactgcatcactgtatgcaacatggaaaatttagatcctgtaggagttcatactggtgacagtattgttgtagcgccaagccaaactttatcagataaagaatatcaaatgttaagaacctctgctttaaatattattacagcattagatattcaaggtgggtgtaatgttcaatatgcgctaaatcccgatagttttgaatactgtgtaattgaagtaaatccacgagttagtcgttcttcagctttagctagtaaagctactggttatccaattgcaaaactagcagcaaagattgctttagggtacacattagatgaaatcatcaatgcagtaacagggaaaacttatgcttcatatgaaccaacattagattatgtcgtatgtaaaattcctaaatggccatttgataaatttgttgatgcttcaagggaattagggactcaaatgaaagcaactggagaagttatgagcatttgcaataattttgaaggtgcgctaatgaaagcattacgttcactggagcaaaatctttactatttgcatctagatgaatttgatggaaaagatgttgaatttctccaaaagaaattaaaagatgttgacgatcaaagaatttttgcggtagcagaagcattacgccaaggaattagtgaaaaagaaattcatgatatcacaaaaattgatttatggtttatcgataaaatcaaacatttagtagaagtagaaaaggaattacaaaataaagaattaagtggagagttattgaaaaaagctaaacgtttagaattcccaaatcaagtaattgctaagttaacaggtaaaactagtgatgaagtaaaaaatatgtgccaagaaaataaaattaacgcagtgtataaagtggttgatacatgtgcggctgaatttgatgcaacaactccatattattattcagtctatggtggagtaaatgaagtaaatccagctgatgataagaaaaaaataatggttttaggttcaggaccaatcagaattggacaaggaattgaatttgattattgctcagttcattgcgtttgggctttaaaagaagctggttatgatacaattattgtaaataataatcctgaaacagtaagtactgactttgatattgcagatcgcttatattttgaaccattaacaccagaggatgttgagaatattgttaatatcgaacatcctgatggagcaattgttcaatttggtggtcaaactgcaatcaaactaacaaaggcattaatggagatgggggttaaaattttaggaacatcagctgacgatgttgatgcagctgaagaccgtgaaagatttgatgagattttagaaaaatgtgaaattgatcgtcctcgtggttcaacagtctttacaattgaggaggctttagaagttgctaatcgattaaaatatccagttttagttcgtccttcatatgttttagggggagcaggaatggagatctgtttaaatgatggtgatgtaaagaaatttatgaaaatcattaatcgtcaatatcaagaacacccaattttaattgataaatatttagctggtaaagaagtagaagttgatgctatttgtgatgaaaatggaatactgattccgggaattatggaacatgttgaacgtgcgggagtccattcaggtgatagtatatcagtttatccaactcaaaagatcaaacagcatattaaagatacgattgttgaatacacaggtcgtttagctaaagctttaaatgtcatcggtttaattaatattcaatttattgtatatgaagaccaagtatatgtaattgaagtaaatcctcgttcaagtagaacaattccatatatttctaaagtaacagatattccggtggtagatgtggcaactcatgttattatgggaaaaacaattaaagaacagggatatgaatatggcttagcaccagaaaaagaaacaattgcgataaaaatgccggttttctcttttgaaaaaattaagggagctgagattagtcttggtccagaaatgaaatcaacaggagaagtgcttggaatttcaactgattatgatgaggcaatttataaagcatttattggttcaggaatcaatttaccaaagaaaaagaatattatttgtacgattaaagattctgcaaaagatgaatttttaccaattgcaaaacaatattatatgtttggttatgatttatatgcaaccgaaggaacttataatttcttaaaagaaaatgatgtaccagttagtttagtgaatcgcattagtgctaaaagtaacacattgtttgatttaatgttaacagatactgttgatttaatcattgatattcccactcgtaatgataacttaaaagatggtttcttaattagaagatttgctgtagaagcaggaattccaatctttacttcattagatactgctcaagcattgattactagtttagaaaaacgtcataaaggggatacttctttagtagatattactaaactaaaatagtttaaaacagacttagtgagattgcatcattaagtctgttttttgtaaaatataaactttgataagtagtttcttgataaaattatggtcaataacattattattttgagttgttaatgaagataattaactttatgtttttttatattgaagtataattattgaaagaggtagataatatgtatacatatgaaatgctatatcggttgtgtagctaagaatctagtgatagtgtgattgcacactatttattaatgcatttaaattcattggaacagttgacgattaagaaagttattgatgatgtagggatctctaaggcttctttacatcgtttttttagtaagggtggctatgagagttttaaagacttaattactatattagatgaagaagtaaaacagaaaaaaatgtttaatattgattatcaacagtatcgttccaatatggcttggagtgctctagaaactgagtttgaagatcatcaaattagaattctaataaagacaataaaaaaagctaaacgagttgttttttatggtaattcatgggagatatcatgttttaaaagacttagtttttatttatttaatcatgggatcgatatttaaatttttataatcttagagtttcttataataagattatatctagttaaaagtaatgaaattagattattttcttgatatgggttacaattacatatggaagtgataaaatgaatatgaaaagatatgaatttgatgctgtaattaaaaaagtaccgaatatagatggtgcttatgttgattttccatacgatgtaaaaaaggaatttaataaaggacgtgtaaaagtcattgctacatttgatggaatcgaatatttaggaagtttagtaaaaatgaaaacccctaatcatattattgggttgagaaaagatattcgaaaaataattaataaacaaccaggagatattgttcacgtaacgattcaagaacgtgaataatagtaaataaaacaaggggtgaaaaagatgctaaaagtagagtctaaatacacaaagaagtacctattcgccatcttgttttttattataatgtcaattatatgtgtaactatttttttaactaatatcaatagtgggattaatgaaaaagttcaagaaattttacttaacgaagtgatttctcatcgcaaaagtttggaagcgacgatctctatacaatatcaagaattagaagggatatctgggtatatcactagcttaaacacacgtgatatgtcacaattgataaattttactaaagcatttgtttctaaaaatggatttgatcgaattgttgtggcgtttgaagatggaattggatatctaagtgatggtagtagttatgatataagtactagaggatattatcaagatacgatgaatggaggagctagaaatagtgaaccagtagattcagttattgatggtgagcgtaggatggctttatctgttccaatttatagtcaacatggtcaaataatcggtatggtaatgggatcttatgatgtacgggcaattagtgaaattgagttttctaatttatataataacaagggttatacttatttaattgattattctggtaattttttgattaatgatcagaagcttcataattatcaaggaaatttttatgactattgtcaggaaagtaatattttaagtaatcagcagctacagcagataaaaacagacattagtaattatgtttcaggatgtgttttgactaaaggaggtaaagaaacacgctatttagtatatgttcctttagagtcaagtgagtgggtaatttgttattctgtattagtctctgatgcatttcaggattatcagtttattatgaaatatgagacatatttgctgggagctgttgcaatggttctaacagttacggttctttatatttttattgtaaataaaaaagagcgtcgtgttttgttaaaaagagctgattatgatagtttgacaggtttatataatcgtcggaaattaacagaggaaattaagaggtatttaaaagctcaaagtgaatttggattagcgattttagatattgatgattttaagaaaatcaatgatacatatggtcatcctattggtgatattattttgaaagaaattggacaaattttaagagataatcttggtgaatatttggtcggacgtttaggcggtgacgagtttgttatcttaattgaaaatgttcaaattattaatattgttattcaaaaacttgaactgacttgtaaccaaattgctaaaataaaaatagaagaacatccagatattgttgtcacatgtagttgtgggttagcagttgcaccaaaggatggagaaaccgtagcggaactatataaggctgcagacagtgccttatatattgctaaatcattaggaaaaaataaattggcaaaattttaaggagaagaagatgagatatacaggatttgtaatatcagtaaaagacattaatgcatcaaaaaaattttatgaagaactatttgatttagaagtttatcaggattatggaataaatattacgtttgattgtggattatcattgcagcaagattttgactggcttattaatatagagaaagagaagattattgaaaaagcaaatgatcatgaaatttgttttgaagaagaaaattttgatgcatttttaaaaagattatctgtgtacccacaaatagagtatcttgatgatgttatagagcatagctggggtcaacgagtagtccgtttttatgacttggataaacatattattgaagtaggtgagtcgatgaagatggtaattaaccgttttattgatcgtgggatgacaacggagcagatttcaaaaaaaatggatgtgtcagttgctgatcttaaaaaactgcttaatgattaaaaagaatattaaagtaataaaagaccgtcaatgatcttattttaaatctaataagttcattaaacggtcatttttttctaatgatttaaagacaagtgcgccgataattaaaacaattaattctccaacagcaacatagattgcgtttattacatatggaatattgaaagcataccataattcagccccaataatcattcctgttataattgctcctgctccagcagctaaatagcgatttttaatcaagtacatagcaatacatactataatcgtacttaaagttccaaagacaatatctaacattcccattggtgaaaatagattagcaataatgcaaccaatcgttaagccaggaatatagcgtcgattataaaatgctaaaaaaacaattatttctgatagcctaaattggatttctgaatatgcgatgggtgagattgctaaagtgagtacagcataaacccccgcaatcatcgcattgattacaaccagttttactgaaatacctttgttcatatattatatcctttcatagtattattttcacttaaatgtcacctcattgaaaacatggatattatatacgattttaagtaaaaagactagtctttctgtataggaatatgagaattaaaatattttatataaatacaacaatatttaaaattaaatacttgctctttttatcaaaaagattaatcccaattaataaaatatgtgatacgataataatgatgtataattacgaaaggaaggttaacatgtcacatcgtatagtggtgcgcaaacacgaaaaaattgattatcagcgcagtactttctttacacttgcccacacacattatgataaagattattatatggaaaatcattggcataatagtattgaaatcacttatgtagtaaagggcttaaaggttcaacagatggagaataaagaagttattgcaccagcaggaactttgttattagtgaattcgggagtaattcatgatgttgatgtaaagaagggattagaggggattgtcttattgattgaccgtaattatattgaccatgtttgtccacaatgtattgaacgtggttttagcttggaaaaagaaccattagctaaaaagaaaattgtggattatttattcaaattagtagaagcctatgaaaataataataaagttaaagctaatattattgttttagaaattattagtgttttggctgaacagttaatgttagaggggcattatattaaagaaaagcatgatgatgaaagttatgaattagttatttcgattactgaatatattgattatcattatgctcaaaaaattagtttagatgatttagcaagaatgacatgctataacaagacttatttatcaaatatttttaagaaaaagacaggtattactatttttgagtatttacgtaatgtcagaatgcagcattgtttatatgaactaaaacattctgatgatacgattgtaagtattgctttaaataacggatttgcaaatattcaaatatttaatcgtgtatttaaagaagtttatcaaatgacaccaaagcagtatcgtgaaaagaataagaagtaaagattaatgaagattaaaacaaataaacaacaataataataaaatccgccatgctaagataagtgtcaaagaggaggatgttatgaaaaagattaaaaagtttttatcatcgctaattgcaataatgatagttgcaacaatggttacttctaatctaagtgcattagaggtaaatagctcgtttgttcaaaatacgaacacaagtaatacatatggttatgtaaattatgaaacagatcaatttgaaacttatagtaaggtttcaggaagtgctgggaattatacaagtattgcttcaaaagtttataaaccattatctggagatactctaatcgttgtttttcatggtaatggagaaggtggtgttgatggggttagtaataactactcacagatagctgctaatcgtttagctgtaacttatacaactgatgaactacaaagtgcttttaagggagcttatgtattagcttttcaagcaccagattattggtataatgattatacgcaacaagcaaaaactattattgatcaagctatagcagaatttggaattaaagaagtatttgtttctggattatcagcaggcggtttaatgacacaacggatgttagcaaaatatggtgatttctttgcaggcgcattaatgtcatgtgctgctattgctaaaaatgaccaatatgttgaaggtctaggtggaaattacactgattctactgaatatttagatgctggtgatgcttatacaagtggtgatacctttaagaaaccagttgatttcaatcaatatttagctaattatgacgaatggctagaaaatattgccgtaagcaatgttccgattttcatggtacattgttattatgatacaacaatctattatggatggactcaatatgcttataatatgattaaatcctatcgtgatgacagggggcttgatggagatatctactgtggtttatttgaggatgtcagttatcctgatgaaacatatagcagcgctcactggtcgtggatcaaaatgttgaatggtgatgtttatgcttcaactaatgcgagtttagatacgattacatggtttaaatctttatcaacttcaactaatgattatcaattaaaaacagttactaatcctgtagctggagaagcagcaggtgacaatatttatgcttataacttaattgctacagtaactaatagtggtgaaaaaataacggctcttgaaattgatatgaacggtaagaaagttgatgcttctaaattaacaactgagatgtttaaaataaccggatacaatagtgatgctagtggtttggttaaaggtgatgttcagtcttatggaatttttggaagcgaagatgagcctgtagatattgaggtggctagagtatcagtaaatgaaaagggtaatatcatattagatttagcaacacagaatggagtattaaattatacttctttggctcgtaatcttgcgactaagattagatataaactagcatcagtagctctaccaatgattgttgaggataattcaacaacaaatcctgatgataaacaaacagctgttaaaacaggcgatgatttaaatgttttaggtgctggaagcttaatgattatttcattgatgatggtagctgtatctaaacgaaaatttgattaagaaaaaagttctacatttttgtagaactttttataactatttaaataaacctaagttaatacaagcgttataaataccatcatcatcaatactgtcagtgacaaaagttgcaatgtttttaagatatgcgtcaccttgtcccatgcaaatagagatagcagcatgattaaacatctcaacatcatttaaagaatcgccaaaacaaatatatttatcaagattatattgttttaagataacttgaataccagttgctttagttgcatcggcatgagttatatcacaatatgtagagactccgggtaagatatgtaaaccttctaattgtttaaatggcgcataatcatatcccttcggtccataggcaatcatcgcttcaactttttggttttgataaatgcctaccggagggatgatagagttaaaaaatttacgtgcagtgtaaacattttcatcgggctcttgggtaatgattcgatgctccatttttaaagcgagtggaatattattatctttagcaatttttatacaacgatggactatttccggggaaataaccaattcttcgacgatttgaaaatttttattaagcacagtttgaccattattacaaacaaagccgtcccaattagcaatatcaacaaccccggtacgttttaatgaattaacagcacgaccagttgcaattccaattttataaccattctcttgtaatttttgtaatgcttttttagttgatggagtaacctggtagtcatggttatccattaatgttccatcaacatcaaagaaaatcattggtttcataagctcccccttttcatgcgtatattttagcaagcatacctatgaatgtaaacaaaaaaggaatatgactaaacatattccttaattaaattattttccgcttggtaaaaatggaattaatcccgctgctacggcactgattggcattgattgaagaactacttttcctggtcctgtgacaaccgtattaaaaaaaccttcaccacctaacagtttatttttaactcctttaacgctttgaatttccatcttgcatgtagcatccatcatagctagatatcctgtatcaataaccatttgttgaccaggtaataaatcgtaagaaatagctgaaccgtcaatttctaaaaagacagtacctgtaccgctgatcttattcataatgaatccttcaccaccaaaaattcctgttgccatttttttattgaaaaaaactgacatgtcaattcctgaagttcctgctaggaatgatgacttttgtacaataatttcatgatttggattaatttcaacagcttcgattgaccctggaaaagaagatgcaaaagcaatcatgccgtcttctttagcatgataacgattttggaacattgtttctccactaaacattcgaccaaatgctttaccaaaaccaccacttgttgtttccatttccataacgggatccatccaactcatggcaccgctatcagtaatcattgattctcctttttctaagtgacaaatcactacagggagattgtcccctttaatctcgtatttcattttatttctccttatttattgcgatacaaactggtgcaggaatagctaaagttgaagctgttctaactagttgttcgcttttttcatcaaatgttaataactctaattcatcatcgtcttgcgcaccaacaattaaatatttatcatcaataatattaaaatcacgaggatttttaccagtatgaaccatatatagtaatgaaactttaccagtttcttggttgactcgatatagaacgatgctatcatgaccacggtttgaaatgaataaatgatttcctgtcgcacttagacgaatagcgctagcgctcgaaaaaccgtgaaaatgacgaggcgttgtatgaataacttgaattagatttaaatatttatcattatatttataaaccattaaattattagaaatctcatttactagataagcaaaacgaccatctttagagaaaatcatgtgacgtggtccagagcctggtaccacatttaaagtatgttcaacatcttcttctaattttccatcctgataagtatacatgattactttatcagctcctaaatcaacagcataaacaaattccttatcaggggttattccaacataatggcagtgtggtccagtttgtcgttttagtagatcgggaccaagtccagtatggtggatagcacagattttttctttaataaaattattttctaataaatatgatgctgtggaaccaacatgatagttagctgcaaaaagatatcgtgaattatcactaacacataaatgggtataagaacgtccattagaattataattattgttgggaataagttcttctttgtgaattgaaaaacttccaattccacctccattattaagtcgactagcatttttgtaagctacgtataaaatattatttttagtgatcatgtaagatggataatcatgggttactatatgttgtaccagagataatttttgattttcttcattaagatcaataatgtaaattcctttattgtcacttttaccataactagatacatagaatgttttcatgttaaaacctccttgtttttattttatcataaattattaatgaaagggttttattataccatttttgcaataaatttttattcttaataaatgttttattaactactaacctttgaatttgattataaatggttgattataaaaataaaagatatttagtaatttatttgtgtagacaatatatattgtttggactattatagtaaataattagtgtatttgtttataattaaaagtgaaagtgagatggtataagtgaaatcatatcagaagatagaaactgctgctaaggaacttgttaaaacaaaaaatttgagaatattactgttaaaatgatctgtcaaatggcaaatgtttcgagaaaaactttttatgcattatatcatgataaatatgaagtgattgaacgcattgttgttgataatgtgattagtgatttaaaaggaatgctagaattgttaggaaaggaggaattaaatcaaccgattatattagaaaagatgtatcaacatttttatgacgaaaaagagttttatgtaaaggctataaatattgaggggaataattctttagaacattgtcttttatattgttttgaggaaattaacttagagatattaaaagatgtagaaataagtttagtcgaaaaggagtatgcagcttacttttttgccgcttcacaagttatgttaataaagaaatggttgattaatgatttagaacttacaccacgagagatggtgttaagttctcataaatgggcagttaaagctatggttaataattatttttgaagaaggtgacaaatattaatgattgttacttttttagttacgcttagtcttacctgaatttagcgatagaatcttattgttaagatcactgaaaacttaactatggccgtgactggtttagaagaaattattgaagtacctgattaagaaatacctaacaataatggcaaacaagatatccaaaattattgggatctacaagtgatgggattaagatggtacctatatagattatggcaattaatgtaattggggtgatagtggtgaaaaagaggaagaaaagctaaatgttggaagtcactttgaataatggtttttaaagaaaaaaataatgattgtaatagttcttcacctttacctcaaacataaaatgttatataatgagtaaaataaattggaggaaagaaatatggatgagaacttattattaacattacttcataataatgcacgtatggacgttacggatcttgcgatggcattaaacgaaacagaagataatgttgttgataccatcagccaattagaaaaggataaagttatctgcggatatcatacgattattaattgggatcgtacaaacgttgataatgtaatggcattaattcaaattaatgcaactcctgaacgtgagtatggttatgatcgtattgctaaaaagatctatgcattcccagaagtagatacaatgtatttgctaagcggaagctttgaattcgttgcgattgttaaaggacacacaatgcaagaagccgcccgtttcgttgcctctaaattggcaccattagaaggggtaactggtactgcaacaatgtttgtattaaagcaatataaaaataatggattaagttttgatgatgatgacaaagaagctgcagaaagattattggtaactccataatggatttcaataaggtattaaatgatacagtaagagaaataccacctagtggtattcgaaaattctttgatttagctaatcaaatggagggagttatatctttaggggttggggaacccgattttgatactccatggaaaattagagaggctgcaatttattcaattgaacaaggtaaaaccttttatacagctaatcaaggtttagtagaactgagaaaagaaatttgtcgttatcaaaaaagaagatttggtttggattattgttatgataaggaatgtatcgttacagttgggggctcagaggcgattgatcttgcttttcgtgcaattatcaatcctggagatgaagtgattttattacagccgagttatgtcgcatatactccaggagttgctttagcaggtggaaaggtagtaaatattgagcttaaagaagacaatgagtttaaattaacacctgaattattagaagctgctattacacctaaaacaaaagcaatcttattaaactatccaagtaatccaacaggtggatttatgactcgtgaggattatgaaaagattgtttcaattataaaaaagcatgagattattgtaataactgatgaaatatatgccgaattatcatatgaacaaaaattttgttcaattgctgcatttgatgaaatcaaggatcaggtaattttagtcagcggatattctaaagcttatgcaatgacaggctggcgtttaggatatgtattagctaatgaagttttgactaaagcaatgaataaaattcatcaatatgtaatcatgtcagcaccgacaggtgctcaatatggagcaattgaagcaatgcgtcattgtgataatgaaattgaagaaatgcgaaaagcatacatgcttcgtcgtaattacattgttaaagcatttaatgatttaggattacatacatttactcctcaaggagcattttatgtattcccgtgtattaaatcaacaggaatgacttctgatcaattttgtgaagaattattaaaggatcaattagttgcttgtgtccctggtactgcctttggggaagctggtgaaggatttattagggtatcgtatgcttactcaatcgaacaaatcaaggaagctacatcaagaataaaaaaattcctagataaattgaaaaaataacgttaatagcgttatttttttgtattttcatgtgatacaatagtgatatataagttattggagggatagcatgaaaaatgagcagttacggaattttattaaagttgttgattgtggcagtatcaataaagctgctgaacaactttatgtttcacagccaagtttaagtcgttcaattcattcattagaagaggaaatggggaaagaattagttattcgcagtaatcggggagttacacttacgccaacagggagattgctatattattacgggcgctcaattttagaacagtttcaagttttagagaaattaaagaatttaagtgaggaatcgatttatagtaaattagcagtatcagtcgattctatttttttaagggatgacctgattttacaattctataatcacattaagtctgcagatactgaaataaaaatgattgagactacggcagaagaagttctaaataacgttagtgatatgacatctgaaataggaatagtaattctaaataattatcagttggcaatctttagaaaaatgacagaattgaaagatgtagaaatgattgtacttggaacaggaccattatatgttcatataaacgaacaaaatccgttagctaagggcgaaattatagatgctaaagaattggttagcagtacatatatccatttgcctcatgatttcttttctaatttaaatttatcactaacgattgacggcagtattcaaatcagcagttttcataaaactattacgatgagtaattatcatgctattatcaatatgcttaatcatactgatgcttttatgttggggcataaatggcaaatagaagaactgaaacattcaagaataaaaagtatgcagtttcaaaattgtaatataaataaatcattcattattattaagcgtaaaagagaaattttatcagatgctgctaaaatatttttagaaattattaacgataattatgcggatatgtagatatacacaaaaagtataactagacctaccaagataagtattaactgctttttgaatttagtattagaatataggtatagaaacaggaatgacaaattccgacacatataatataaaaaatactaaaggagaaaattattatgaaaaagagtacattattaacaatggcatcagttggtgccgtagctttaacttctgcaatgacctttgcggcatgggataatttatctgatactactacaagcaatgaagtgacatttaaacaaattaatgtggaaaaggcagctgatattgttcttaccgagccagttgctagtgatttaactagttcttacgtacctagttcaagtggggaagtaacatttaatataacaggtatagatgcagctgatttaagtggtaaggaactaaaattagaaccagtagttaaagctaatgatacagcaatttcaactggctatactttagaaatttatgatggaacagaggaatcggcagaaaaagtcgccggtaatgttgataaaagtcttactggaactaatacttacaaagtagtagttactgcaacagatgataaagctggaactgatgcgttagcaaataaaaaagtaactgttgaactaaaagcaacattacaaaagactactgtttaatgctatcaataatggcatttttgtccaagtatataatataggatgtgaaagtcatgaaagaaaaggtgagaaaatttagcaagctggcatattggctgatattgggaatgatattgatgtatattgttgggatgcaattttatgctcaagagataactgattttattggatatcgcttttatgcagtcatgacggatagcatggaacctagaattccaacgtattcaatggtacttactaaaacaattgatgaaaatgaatctattgcccctggagaaataattacatttaaagttcagcggggagagcaagaaatagtgttgacacatcattttaataaaacacaagaagaaaatggacaattatattatcgaacaaatgccgagggtcgagatgaattagatctatattatacaaaacgtagtgatatcattggtaaatatgtttggcatataccattattaggaaagtttattatgtttattcaaagcaaattcagttggattctatattgtgaatttttactgatttggctaatcaataaaacaataaaagctcactgggaagaaaagggagagcttgatgatgaggttaaaataccgcgaaaattggataacgcttagttatccttttttttgttttattttagttaagggaatgttaagaattagtaaagtgtatatgcttgctcaacaaagtgtaatataatgatgagaaatccggaggtggaatagatggaaaaggaattacctatgtattatgaagtgggtttaaatgatagtgaagtccaagaaagaattgctaaggggcaagttaacggagttagtaaacctgtcagtaaaagttatgggcagattataaaagataatgtttgcacattatttaatcttttgaattttttaatatttgtagctttagtatttgttcaggcttggtcaaatttagtttttatggcaattattgttaccaactcagttattggaatttggcaagaagtaaaggcaaaaaaactagtagatcaattatcaattttaactaagccaacaattatggttgttcgtaacagtagacatgtaattgtcgatattaatgaagttgttctagatgatgttttagttcttgaaagtggaaatcaagtatgtaatgatgcaactgtgattcatggaatggttgaggccaatgagtcactattaactggggaatcagatccgattcataaaaatataggtgggcacctgctgtcaggtagtagtgtagtttctggaaaatgttatgcaagggttaaaaatgttggtgatagtaattatgcaacaactattgttaaagaggcacaaaaagttaaagagaagaattctgaattaatggattcaatgaataaagttacaaaagttactacttttatgataatcccattgggaattattttgtttgttgaagcaatgtatttacgacaagatacgttatttaatgcagttgtctcttcggcagcaggattattaggaatgttgcctaaagggttagtcttgttaactagtgtgtcgttagcaaatggagtgactcgtttagcaagacgtaaagtgttgattcaagatttatattcattagagacattatcgcatgttgatgttttgtgtttagataaaacaggaacaatcactgatggaaaaatgaaggtcgaaaaaacatatacgttagaaacaactcagaattttaaactcgatgaagtaatgggctcatatatgcgtgccagtgatgataataatgcaacttttcaagcgatgaatagctattttggagaaaataatctttatgaatatgttaaaaagatcccattttcttcattacgtaagtggagtgcgattgaatttaaaggtataggaaccatcgtcgtaggagcagcagaaaaaattatttctggtgaactgcctgaagatattcatgaattaatgttgcaaggaatgcgtgcgattgccattggttatactgaaaagactgttgatgataaagaagagttgccacgattacaaccactaatggcgattattttatcagatacaattagaaataatactaaagaaacattagaatattttcatcaagaaggaatagatgcgaaaattatttctggtgataatgtaaatacagttatggcaattgctaaaaaagcaggggtattaaattatgaacgttgcattgatatgtcaacgataaatgatgatgaaattcaagaggtagttcgtaattacactatttttggtcgggtaactcctagtcaaaagaaaatgattgtcgaagctttaaaaaatgatggtcatcatgtagctatgacaggtgatggagttaatgacctgttagcgttaaaagaagctgattgttcaattgcaattgctgatggaagtgatgcttcaaaacaaatctcacaagtagttttattaaattcagattttacatgtttaccagatgttcttctcgaaggacgtaaagttgttaataatgttacgcgtgtagcgggtgtattctttatcaaaacaatttatacgattttattatcgttgttttgtgtaatcagtaatactgccttcccatttattccgttacaaattacattaattgatttattgattgaagcaatgccatcgtttatgacgatttttgaagctgatactcgtaaaattactggacgttttttgcctaaagtatttagtaaagcagctggtaatgcactaagtattgtgattttattcattgctatcatgatttttggaccaatgtggaaaataaatgatttagaactagtaacattaatgtatttagttttaggaactatttctatggcagcggtaatacgctcttgttatccttttacaatgttaagaattattatctgtacgatgatggctggaggtttttatggtgcagtattattatttagtggtttattacatttagcaccgataacattaaatttagtttttattggtttaatcttatctatttttggactatttattgaaagaattattcattttgttattaagaaaagactcgcataattgttaagggattgaagactttttgctaatttaaataaatatattttattgatagctaaggaagaacattttatctgaaatggatttccttagtttttcttacgacaaattttaacaaaataattaaaaaccaaaataacggtttttaattagcttatttttggtataaaaattttttaaattactataatagaagtagttaaaggagtgatatcatgaaaaagcaaagttatcaaaaagttatagataaggatattattgaagttaaacagtatttattggatataagtgaaggatattggatgcaggatatccatgatcttattaatataagtatggatgttaaaattattcgcaaaaaattaatgagacgtaaggatttagaattagcagtatttagtaagataaaaaaactaattgatcaggctcagggtttaaatgagatggaaaatcatttgatcatgatgaatcttttattggataaacattatagtccgatgttgacatataaatataagttattaaattatattattgaaaatggtggattttcaattgaaacgtattgtttattaagacatctaattaagtttactaataataatcttaatgattttatcatggctttggctacacgtttaaactttagtaatgaacgttatcactatcttgcaagtcatatcttattattagaaaagcaatataaaaaagtatataatcatcttgaatacattacaattgatgaaagactgggacgttatttaccggcgttgtataactttagtccccgattatacaacaaatatgctagaatgatgtatataccattaaatttagcgataatgtaggagtaaggaaattatgggtgaaaaactgtattatgtttttaaaatcattaaggaagctagggagccgattagtgctaaagatattttaaagcgtttggaaaattatgagatttttctagatattaaaacggtatatagtttaataaaaaaacttaatgatttttattattgtttgagtaataagcagttaataaaaacaattagaagaaggggttatattattgatgaggatttttttgaagatggacagctgcagctattaattgacagtgttttatttaatcccaatcttgataaaaaatcagcgaatgatttagttaataaattagctttgattagttcagttattcaaatggaacgtttaaatacggaacatcaaaatgataatgaattaacatatgatctattattaaatttaactacggtaatcaaagcaattaataaccacaaaaatattgcttttaaatatattagttatgatatcaaagataatgctcttcaagaggtataccatactaatggtaatcttaatcctgaaacatatgttatttccccatataaattgattcttagaaattctaattattatttgattggttattttgataaaagaaaagatagtttaagtgtttatcgaattgatcgaatgcgtatcgtgagaaatcatagcagtagttatgaagatattcaagatcgtttcgatatggaaaaagaatttgaaaataatgttaatatgtatgttagtaatgaacgaatcgatttaaagattgcttttgaatctagtgtactaagagaagttgttaatcagtttggacaagatattaatgtaaataaatgctttgatggtcgaattgaagcatttattaaagatgtggctttatcagatggtttaattggctggataatgatgcttcaagataaggttgaagttgtttttcctttaagtctaaaagagattgtaaagacacgaataagggctatgttaaggatatatgaatagagaacttgagggttctcttttttctttacgtaaacttaacataataaatacaatttattgatatatcgtaaattgcaatttgattattatataggtgtcttaagaaaagataaagaaagggattattaaatatgaaaaaagtattcggagttttattaacattagtattatgcttagggcttactggatgtgggggatctggtgatgattcttctgcaagtggaaacgatgtaagcggaaatgttagccttaacgggtctacatctatggaaaaattcgtaaatgctttaaaagaagcgattactgaagaatatccaaacttaacattagaaccacaatttactggttcaggtgcagggattgaagctgttacaaatggaactgctgatatcggagattcttcaagagctttaaaagatgaagaaaaagcaaaaggaattgaagaaaatattgttgctattgatggtattgctgtagttactcataaagataacaaagtgtctgatttaactactgatgacttaaagaaaatctatactggtgaaattacaaactggaaagatttaggtggtgatgatcaagcaatcgttgttgttggacgtgaagctggttcaggaactcgtggagcatttgaagaaattttaggaattgaagatgcttgtaaatatgctcaagaattaaacgaaactggtgcagtaatggcaaaagttagtgaaacagcaggagcaattggttatgtttctttagatgttgttgatgacacagttaaatcattaaaattagatggtgtaaaagcttctgaaaaaactattaaagatggaagctacactttacaaagaccattcgtaatggctactaaaggaaaaatcagtgaacaaagtaaagaagtacaagctgtgttcgattttatcaatagtgaagctggacaaaaagttattgaacaagttggtttaataattccagataaaaaataggagttaattatggaaaaagatatgttatctattataagtaatagaaaaacaaaatctttggtagagaaaacagccgcgataatttttcgtggctgtgctgttatgtctatcattgctgttgtctctattacaggttatatgattatttctggtacaccagctattttcaaagtgggaatactagatattctttttggaactgtttgggcgccaaccgctgctgatcctcaatttggaatccttttaattatacttacctcaattattggtgtttttttagctatttgtattggggtaccaatcggattgtttacagctatcaatttagctgaattggcaaatccgaaagtgcgtaaaattgttaaatctgcaatcgaattacttgccggaattccttcagtggtatatggattactaggaattttaattatttgtccgtttatgtataggttagaattattaatttttgcaggatcaaagactcatcagtttactggtggggcaaatctgatttcagcaattttagttcttgcgattatgattttaccaactttgatcaatattactgaaacagctttaaaggcagttccagatgattatcgtaaaagttcattggctttaggggcaagtcaaatgcaaacaatttttaaagttgttttgcctagtgctaaatcagggatagtttcagcaattgtattaggagtagggcgtgcaattggggaagcaatggcaattttattagtagcaggaaactcagttaatctgcctttaccattcaattcagttcgttttttaactacgggaattgtttctgaaatgggatatgcctcagggacacaccgtcaagttttatttacgattggattagtactatttgttttcatcataattattaacttgatcctaacatttattattaagagaggagatcagcatgaatagtatctttgaaagaagacatcgcagcagcgataaaatattaaattttttgatacagctttctagtgccttgtcagtgctgatcttggttgtatgtattggatatattttatatcgtggattaccatactttaatttttcatatttaattaatactactagtattttaaaaggtacggtagggatactaccaaatattattaacacattatatattattgtaattactttattaattgcctgcccaattgggattgggggagcaatctatttaaatgagtatgcaaaaaataagaaatttgttaatattatttcttttacaactgaagtattagcgggaattccttcgattatatatggtttatttgggatgttattttttggaaatttattaggatttaaattctcaatattaacgggttctttcacacttgcaattatgatcttaccaattattacaagaaatactcaggtagctttagaaggggtaccaaaaagttatcgtgaagctgcattgggtattggagctactaaatggtatatgattagaactgtgttattgccaagtgctatgccaggaattttaacgggtgtgatcttaggaatgggtagaattgttgcagaatcagcggcgttattgtttacagctggttcagtaagtgttttgccaaaaaatatctttacacatttatcaagttcaggtgcaacactaacgattcaattatatttggagatggctaaagctaattatgaatcggcctttgtgattgccttagttttaattgttattgttttaggattaaatatgttagcaaaactgattacaaataaatttgatgtaaatagggtggattagaatggaaaataaaattgaagcaaaaaatctagatctgtattatggtgaaaagcatgctttaaaaaatgttagtctagatattaaaacaaataaaattacggcttttatcgggccttccggttgtggtaaatcaacatttttaaagacattaaatcgcatgaatgattatgttaaagatattaagataactggtagtgtggttcttgatggtgaagatatttatgatagtcgtgttgatacaacggttttgaggaaaaaagttggaatggttttccaacagccaaatccgtttccgatgagtatttatgataatatcgcatatggaccaagaattcatggaatcaaaaataaaaaacagttagataagattgttaaagattcattagaagcagctgctttatatgaagaggtaaaagatcgtttgcacagcagtgctttaggattatctggaggacaacagcaacgtttgtgcattgctcgtgctttagcagtagaacctgatgtgatcttattagatgaaccaacaagtgcattggatccaatttcaacattaaaaattgaagaattgttaatggaacttaaagaaaagtatacgattgcaattgttacacataatatgcagcaagcgagtcgtatcgctgattatactgcgtttttcttagtaggtgagatggttgaatatggaaaaactaaggatgtttttgcaatgcctaaagataaacgtactgaagattatattaccggaagatttggataggagaaaaaaatgttaagaacaaattttgaaaatgatttaaacaaattacacgtagatcttgataagatgtgtcatctagttattttagcaattgaaaactgtattgtggcatttaaatcaggagatcgtgaattatgccgtgatattttagctggagacaaagtgattaatgatatggaaagaacgatagaagctcgttgtctatcgttaattttaaaacaacagcctgtagctagtgatttaagaaatgtgtctacagctttaaaagtcgttacagatttagaaagaattggtgaccaaggagcagatattgcagaaattttattagatacagatgtaacctgcccttataaaatggttgaacatatacctaatatggctcatcttgctaaaaatatggttaaacaatcaattgaagcttttcatcagcatgatttaaaaaaagcttcagaagtaaaaaaattggaagatgatatggatggactatttgaagaagttaaggtagaattaatacaaatagtaaatgagtcaaaggaaacgattgatttagcgattaacttcctaatgattgctaaatatttcgaaagaattggtgatcatgctgtaaatatttgtgaatgggttgaatttaaccaaactggaacagttgataattatcgtttgatctaagggggactgaacatgggtgaacgtatatttgtagttgaagatgatgaaaatatccgcgagataattaatttagcattagtaagcaatggttatgaagttgttcaatttgataatgctatcgatgcactggcagaaattgataaaaaagcaccatcattagctatttttgatttaatgttaccaaaaatgagcggaattgatgcaatcaaggaaattcgtgaaactgatagtgaattacctatcttaattttaagtgctaaagatcgtgagatagataaggttaatggtttagatagcggttctgatgactatatgactaaaccgtttgggattcttgaattgcaagctcgcgttcgctcattattaagacgccatgttactagcgatattattagaactaaacatcttactgttgacaagcaaacacgtttagtaaaattagatgatcagaaattagaattaactaataaagagtatcaattattggtctatttaatggataataaacatcgtgtagttgaacgtgaagaattattaaacgaaatttggggatatgattttattggtgaatctcgtgctttagatgttcatattcgtgctttacgaagtaaattaaatgatgatggccataagtatattaagacgatacgtagtgttggatatcgtttttatgaggaaggtgatggtagtgaataaaactatttttcgctattttctcacagttttattagtcactctagttttatcaagcagtgtttcaatggttattttatcaagtcaaatgttggaaaatactaaacatgatatgctttacgcggttaagttggttgattatcaattagatgaatcacacgatttaaaagcacaagtagatgcattgaatccacttgcttacaatgatcaaactagattaactgtcattgatactaatggtgaagtattagcagatagtggtagtgaagaaattgatgaaaatcataaaggtcgtgaagaagttaaacaggctctaagtgaaggggttggttatgcaacccgttactcaagtactgttaaaagaaatatgctctatgtggcagtatttaataaaggatatatagttcgtctggctttaccatataatggtatttttgataatcttccaactttggttagaccgctaggggtaggcgcgataatgtcgttagtcattgctttattcttatcgaaacgatttgctaatacattgacagcgccaattcaggatattacgacacaggttacaaaaatgaaggattatcgtgaactagaatttgatagttataaatatgatgagtttaatatcattgcttcaaaattggaagaacaggctaaaacaattcatgatactatgaaaaagcttaaaagtgaacaaataaaaatcaatgggattcttgatcaaatgaaagagggctttgtcttattagatagtgatttaacagttttaatggttaatcgtaaagctcaaaaattatatggtcatacaatcaagttaaattgttcaatcaaagactttatttttgactttaaaattattaatgcacttgaccatttaagtgatgaacaacaggtagttgaagttgaaaaggaaaaagaattctataactgttatgtcgctaaggttgattatggggtaactttgctgtttgtaaatattactgagcagcataatgctatgaagatgcgtcaggaatttttctctaatgtttctcatgagttgaaaacaccaatgacttcgattcgtggatatagtgaattattagaaacgggagttatcaatgataaagatgcttcaaaaaaagcattggataaaattcatgatgaagtgaataatatgtctactttaattaatgatattttaatgatatcgagattagaaaataaagatgttgatgtaatcaagcatccagttcatttaacaccactagtagatgagataattgatacgatgcaagtagagattgataagaaacatttacaagtagataaagaattagaagatattacatatacatcaaatcatcagcatatgcatcagttattaagtaatttgattactaatgcaattaagtataatgttgatggtggtaaaattataattaagtcataccaatttggtcgtaatattatcattgaagttagtgatactggacgaggaatttcaaaaattgatcaaggacgagtatttgaacgtttctttaggtgtgatcaaggtcgtgataaagaaacagggggaactggtctaggattagcgattgtcaaacatatcgttcaatattatcaaggaaatattacattaacaagtaaattacatgaaggaacaacatttaaagtaactttaccaatggaagaagaagttatttagtcacagtttgataactgtggctttttattttacctgttcaaattgaaaatttgaacatatagacttaagtcagttgagcatacgaagtatgcgaaataaaaaaccacctgctatgcgggtggagcaataaagaagttatacaaagatatcacctttccgatataatggagttgttcaagctgtcattataagaaaggaaaggtgattaagtatggcacaaaaaacaaattcattggcacatacgaagtggatgtgtaaatatcacatcgtcttcacaccaaagtatagacgaaaagtgatatataatcaacttagaaatgatataagagaaataataataagattatgtcaatataaaggggtggaaattatagaggggcatttgatgtcagatcatgtacacatgttggtaatgataccagcaaagttaagtgtatcatcatttatggggtatttgaaaggtaagtcagcattaatgatatttgatcgacatgcaaatttgaaatataaatatggaaatagacatttttggtcagaaggatattatgtgagtacagtaggactaaatgatcaaacagtcgcaaaatatataagggaacaagagggacatgatatagcaatggataaattgagtgtaaaagaatatcaaaatccatttgaagataaagaaatgaagaaagaaaacaaaaaagagagaagaagataacaaaaggagaaaggaggaaataaatccctttgagggatggcgagagtcaaaagcgatagcttgaacgaagagaaagcagcgccttgagacgcgagcaggcaacataggcttatagcctcagagaaaaccacgtcttttaggcgtggtttttatttgtagattgaagtagtaataaactttttaagcgaattaatttttggtataataagactatgaaaacagatactgaaacacttagaaaacgtggctttttaacaaatacagaagccgaaccctactttttatattcaaaagaggagttattagaactattaaaagataaaacagccgtaaatcgtactgcggcgttatttattcttagaagctttgttgacattaatgaacttgatgaaatcttacttagaatgttggttaaagaaaaagccttatatactaaattagaaatatgcgatattttgactaccggaaatgagttgacaataaaaagaatgattccttatatggggacaattagaggtaatcaacatcggacgattcctgaaaaggtatcaaagaaaaaaagctatcctttgccacgggatattattgctagaactatggctaaaatgaatcctgattatttttctacgattttagaaatcattaattatcctgaagataaagtggttgcagaagcaattgatgcaattggctggatggttttttatcatcaagaattggcaactgctaaaaattatcaaacagttattcaattatttgaacgttatcatgataatgaattgatgaaatggaaattgatcatttgtttatcggcgtttaatcaaagtgaggcttttttaaaacagctggattttcaaaatccagttgtccaagctgaaatagaacggagtttatcgctgatcaataaaagaaaaagtaaagtagtttattaaaagttaataattaggggttataattatagtattatagagaagaggaaaaagaatgtataagattataacagatggatcttgcgatctgtcaaccgaacgtgcacaagagcttgatgtgtcagtagtacctttttatgtatcaacagatgggattaatcatcaaaaggaaattgttgaattgggtatccgtgatttctatcaatttatgattgataaccccaaagtatttcctaaaacgtcaatgccgtcgattcaagattatttagatgtttttggacctttggctaaagatggtattgatattatttgtatttgtattacaacaaaattttcgggatcatataattcagcaatgaatgctaaaaatatgcttactgatgaatttcctgatgtgaaaattgaagttatcgatgctaccgttaatacggtattacaaggaatgttagtagaagaagcggttgcatacaagcagacgggtgcaacctttgaggagacggttgcatatattaacaaaattaaaatcactggaaggatcttctttactattggtggtatggattatttagttcatggtggaagagttggaaaattatcaggaattgcggctggagctttgggaattaaacctttgatcttgcttaaagaaggagaaatatttaataacggattaacacgcggacgaaaaaaatctaaacaaaagatagttgaacaaattattaattattttaaggaagataatttggaattgagtaaatatcgtttttgtataggatttggttatgattatgatgaggctgtagagtttaaaacaacattccttgctgctttgaaagggtttgatccatcatttagtgctgaggtaccaattcggcaaattggagcaacgatcggtgttcatacaggaccacatccactaggtgttggtctacttgaaaaattacaaaagtaaaatgaaaattcaattatgataaaaagacttgtagaccttatttgttaggatacaagtctttttgtatgaaattattttttaaaagttaccgatgctttgaataaatcaccatcaacactaattttaaaattacctttttgcagttcagtgaaacttttagcaatagctaaaccgaggccactaccactagtatttcttgaagtatcaccttgaacaaaacgctcaactaattcatcttcgctaacttttatttcatctgctgatatatttttaaaagtgattgtaacttcatcatcactattgtcaatatcgatataaacacgtgtattttctaaagcgtattttccaatattcattaagagattttcaaaaatacgatatgtttttaaactatctaatgataaaataattttttcatttggaaaagcagttttaaaaattaggcttttttcgttaaatttatctattaattcaaacttagcttgctggatcaatgcaataatatcgacatcaacaaggttgagttttacatcaccactattgactttactaacttcaaaaagatcatcaattaagttctttaatctaagtgaattacgatctagtgtatcgagatattcttttcttttttcataatcaagttgttcgtcttttaacaaatcaatataagtaatgatggaggttaatggtgtttttaagtcgtgagagacattagagattaattcagttttcattttttgtgattttacttcctcgctaacagctttttcaaagccatctttaatattagaaaattcagtacctaaagaattaaacataccaatatcttgattgatttcaacatcaaaatcaccgtttgataaacgtttaacagcatccaatagaatttcataatcatgtttaagttcatcaaatcgttttcttaaaataataaataaaatggcagaatatactaaggcaaagaaaataccaaaggtaaagaaacaacagattattgatataattaagcagtttgctaaaacgattttaagaattgttttatttgtatcatcatttaagtcaaatctactggctttataaattatctttcttaatacattaagtaaccaaatacaaacagtattttttttaatagaattaataatcccttctttaaagaatgattttaaataaaagacagagaacatacataggaataaaaaagctgcccatgatagtacattcatcgctccaaggatcagttcacttgattcaccaaaaccaatccctgacaatttagtaatgtaatagccgtttatggtatcgagaattaaaccataaattacaacgattattcctgcaaatgccaatgtaatcccaattactaatggttctaatttgattttagcgggatatttaaagatgttgatttctttaattgtttcatatggagctaataagataaataagccaacagcagctacagcaattgcagcaaatggcacaatattttcaacatttatagttcgattgtttttttcgctataccaggcaatcgtatcaattgaattgcttacgattttatggggaacggcaaagtagatagttgtatttactggattatgcaatgtactatcttcatcatactcttggagatattgaaaatatgtttgtttataattattccaaactagttcatagttttgattaccagctactaaacagcctaaagtatcatagctaaattgaccattttcatcaaagtgaatcattaaataccattgatatttttctttcaattctttattgttacgaatgttttttatatcgtcattagtattacctaagctattattattgccttctgcatagtatttaatatttttcttttcagacatcatttcacgacaatataaaatattattccgataaaattcatcactagcttcttcgttggcagtaagatattttggaataccttcttttttgctgacattgtcaagctggaagctcagagcatagatattgtcaaaaatatcataaagaatttgattacttgaaaagttaatacttttcccgttactggtttctacaacctcatagcagctatatataccaacactgctaaggagaataattacaattgttaaaattgaaaaaattattttttttctgttcattttatcacctactgtttttcaattttataaccgacaccccagacaacttttaaatattggggattactagggttaatttcgattttttctcgcaaatttcgcacatgaaccatgactgtttctgtgttgattgcagcttcatgccaaacattttcataaatttgttcgcttgaaaaaactctcccgggcttttccattagtaattcgagaatttttaattcaattggagtgactttaacagctttaccgtcaacactaacttctttggtatcaagatcaagttctagaccacccacaacatatttatttgctgcttgatcttcttgaatcttaccgatcatatttaaatatttatgatagcgtcgtaattgtgaagaaacacgcgctaggagttccattggaacaaatggtttggtgacataatcatcaccaccaatatttaatcctgtaattttatcaatatcttcagatttagcggataagaaaataattgggaaatcataattttcccttattttcattgtcatttcaattccatccattactggcatcataatatctacgatagcaagatggatatcatatctttccaccatctctaaaccagctttcccgttattagcaatatatacattataaccttgtgattttaagtatatttcaatggctttggcaatttcaatttcgtcttctaccactaatatattatcttgattcatcctcataccctctttcataatattaattataaagccaatcattaaagaatagtagaaatgatttcaaaagattttctaaagattttttttcttgatgtaacgcttatagctaagaaggccaaaaatggaaataattccagtaattacaaaaataaatattgtaaaacgataattttgatttgagatagcgttgccccctattgtacttgtaattacagatgggattctagcgatactagtaatgaatataaaacttgaaagttttaaacgcgtaaaaggtgcaaggtatgttaaaatgtctttaggagtgccgggaataaagaagatgacaaagaggataatttcaagatttttttctttttttaaaaatgaaatttcattaaatttgttagtatcataaaaatgattaactaacttgatgccatatctattaacaatagcatagataacgatagtaccaataatagcaccaagtaaacaaattgccatcccttcaatagttccataactaaatccggcagcaatctcgattatttcacctggtaaaaaaacaaaaataacttggattgccatagcagcaacaagaattaattttccccaactaccaaattcagttaacttttctttcaattcaataggatcatttaaaaagttttcaaaaaaatgataaagaactagacacagaattgtaataattatgaaaccggttattaaaagcgaaaggttttttttatgctcatttagtttatccatctttttcacctcgttattagtatagacaacgaatctaaaacataactagcaaaagttgaaaagtgattctaaagaaaacttaaagataatatctctatcttgattttctttaccgataaaataagtaacagttattatgctataatacaagtgtttaaatatttgaacagggaggatgaatcgatgaaaaatacaattcaagatagcgaatctttgagaaaacaatttttagcgagtcaaaaagtttttaatgcacttggtgatgagacaagaatgtatttattattgattatgcttgaaggtccatgtgatggtagtcgggtaattgatttggctcccaaagtaaatctttctagaccggcggtatctcatcatttacaaatattaaagcaggcaggaattgttaagacgcggaaagttaagacttgtatttattattatttagaaccgcagcattgtgaaattgataaactgattaatttatttcagcatattaaagagattatgaataatgtatcaaggtgtgaaatggaggaagagtaatggaacttttagaagcagttcaaaaacggcattcagtcagaatgtatcaagatagagaaattccagattctataaaaaaagaattattggattttattaatcaatgtaatcagacaagtggtttaaatattcaattgattttggatgaaccaaaagcctttgataactttatggctcattatggtaaattcagtggggtcaaaaattatttggcattaattggaaaaaagagtgtgaaacttgaggaaatgtgcggttattatggtgagaaaatcgttttaaaagctcagcagcttggattgaacagttgttgggtggctttgacatacaagaaagttaaaagtgcctttgtgattgacgatgatgagcgtttatgttgcttgattacacttggttatggtattgataatggagctacacataaaattaagacgattgagcaagttagtgaagttactggagatatgcctagttggtttgaaacaggtgttaaaactgctttattagcgccaacagcgatgaatcaacaaaagtttaagtttatccttaatgataatactgtcaaagtaaagccgggtctgggtttttatacaaagctagatttaggaattgttaaatatcattttgaaattggagctggaacgaacaactttatatggcaataaagctggaaaaatccagtttttttatcaattataactttcttaaatcaaattacttgaaaaagtaaagttactatgttaaagtgtaaatgtaaggaacggaggaactgaaaatgaaacagtatgatgcaataataattggttttggaaaaggtggtaaaacaattgctggtaagatggcaaaattaggaaaaagggttgcaataattgaaaaatccgctcaaatgtatggtgggacatgtatcaatgaagggtgtattccttcaaaatcattaatcactcaagcagaaaaatataattatcatgatgcgataattaataaagaggatttaattactaaattacgtaataagaattatgcaaaattagctgatttacaaaatgttgatgtaattacagcaactgccaaatttgtggatgaccaccatgtagctatctgtaccgaaaatgaagaagaaataatttttggtgacctgatctttgttaatactggagctactccagttatgcctccaattaaggggctagcaactgctaacaaagtatacacaagtgctagtttgatgaaattagaagaactgccaaaaaccttagcaatcattggcggtggatatattggtttagaatttgctagtatgtatgcacgttatggtagcgaggtaacagtatatgaaagtaatgatcgtttgattgctcgtgaggatcgggatattgctgaagaaattcaaagaattttagaaaaacaaggtgttaagtttgtttttaatgctaatattcaagctcttgctaatgaaggcgaagaagttctagttacttataatgaccaagtttcacaacgcttcgccgggatattgatggctactggtcgtaaggcaaatacagctgatttaaatcttgatgctgcaggtattgaggttaaccaacgaggtgaaattgtagtcaataagtatctgcaaacaacaaagaaaaatatttttgctcttggtgatgtaaaaggtggtcttcagtttacttatatttctttagatgattcaagaattgttatggattatctatttggtgataaaaagcgttctactttaaatcgtggtaatattgcttattcggtatttatttcaccaactttttcaagaattggtttaagtgaagtagaagctaaagctgccggttatgaagtgattgtgactaagttattaacagctgcagtacctaaagctaatgttctaaaaaaaccagaaggattgttgaaagcgatcattgataaaaaaactgagcgaatcttaggttgtgtattgttatgtgaacattcagaagaattaattaatttagtaacattagtgatgaataatgatttatcttacaaggtcctaaagaaccaaatctttacacatccaacaatggctgaagcgttaaatgatttgtttgatttataaaatagaaaaaaggagaaaataaaaatgagtaatgtattatatccaaataaacaagaatttgatgaattaatcaaaaatgaaaaagtattagtagatttttttgcaacatggtgtggaccatgtaagatgattggtcctaatattgaaaaactagcggaagaaaatgctgatgctacagtgataaagattgatgttgataaacatccagaaattgctgcggtatatggggttcaaacaatcccgacactaatagcctttaaaaaaggacagattgtaaatcaaaaaattggatttattccctatcctgaaatcttagcaatgattacaagttaaaatggcaacacatataagtcttgcattagtttttgttgaagggttagtatcgtttctttctccctgtgttttaccaataattcctatttatatgggctatttagctggtaatagtaacgaaaaaagaaactcaaataaaaaagtattattatttacaatcagctttatctttgggatacttttagcaatttttctgatgaatgcgtcaataaatttattacaaagttttttaaaagaacacatgactttatttgttcgaatcggcggtattcttatcgttttattaggaatttatcagttaggatttatcaaaataaattttttacaacgaactttccgtttttctttgaaaacagataataaaatgaatgtgatggtggcgtttatcatgggatttacatttagttttgcttggactccttgtattgggccagcgctgtcatcaatcttacttttagcagctagttcaggtgatttttggtatagtaattttctaatgattatttatgcttttggttttactttaccatttctagttttaggattgtttacaaataaagctttaaactggttaaatagccatcgtgatatagttaaatatacaactaaaataggcgctgttattttgattatctttggtttgatgatgtttagtggcaaacttaatacaattagcaattatatgtcaccttcacaagggcaagtatccactaaccaagctgaaaatagtgatgattcggttaattatggcaatgctttattgaatcaagatgataaaccgattagcttagctgattatcatggaaaggtagtatttttgaatttttgggcaacttggtgccctccctgccaaagagaaatgccggaaattcaaaaactttcagaaaaatatcaaaatagtgaagacatagctattctaacagttgtaatgccaggaggtcaggaaatggatgctgctggaattaaaaagtttttaaaagaaaaaggctttactatgccagttatatttgatgatggtcgtttaagcagtagctttcagattacaagcttaccaacaacatatatgtttgatcgtgatgggaatgtatacggctctgtagttggacaattatcgagtgatatgatggaaaatattattgaccgaacgttaaaaggcaagtaagatatgattgaactgaggtgaataaaatgaaaaagcaatatgatctttgttgtaatatcgctcaaacattaaatataattggtgataaatggacattattgattcttcatgcggtaaaagaaaaaaaacatacttataaagagattcatgagtcattaccaggtatccctacaaatttattatcaaatcgacttaaggagctctgtcaagatgatttattacaatgtgaactatattcaaaacatcctccccgttatcgatatagtttaacagttaaaagtattgatcttgatgatatttataatgctttgattatctggggtgatcgtcatttagataaaagttataaatgtattagccatgatggatgtcaaggtgaaatcgagattgtttatcgttgtaaagaatgtggtgaaattattaataaggaagatttaaaaattgctcccaaagaataatatggttatagtcaaatgagtttatttaacttatttaggctatggcctttttattttaatgcttttctttatagaattagctataatagaagaaagagtggtgaagataatgagaagttcaataatgaagaaatcaattattgttgcaataatactattaattctctttggaactttagcaactttgtatattaataacttgtcagataatctgtatagtgaaactgacgagtatttgaatgatttaaccaatcagacagctaaagcaataaaaaaccggatcaatgaaaatttgacccaattaacgacgataagtttaattattcaacaagatggaattcttcaagagccattacttgattatctaaaccagttggcacaaagggatggggtaaagcgttttggtatagcagatttacaaggaaatgtagtaacctctgatcatcagacttttaatatttctgatcgagattattttaaagattcattaaatggtaaaactgtaacctcgaaaagtattactgattatacggatggtgaggcaatcaatgtttattctgtaccaatatataaacataatgaagttagtggggttttgtttgctactttttatacagataagttatcaagtattttgtcgtctgcaacttataataatgttggttatgcatttatttttaatgaaaatggtgatgttgttttaagtaataagaagacagatgattttaataatattgaatcgttgaatggcattgatcttaatgatatcgatataaatgggaagggcataataaactttcgtgatgaaaataatactcttaattatttgatttatgctaatattgaaggtaatgattggctagttgcttctgtttttcccaaagaagctgtaactgggaagtttcaaaattttattcaaacagcttatcttacctggcttataattggggttggcagtgcagtcgtagttgcttatttttattttattcaagggaaaaataagctgcaaattactaaattagcttatgaagatgagattactggtcattataattactatcggtttattgaatattgtcaaaatatcaatcatttatctaaatatgttttagtaaattgtgatgttaaaggatttaaatggtttaatgaaatatatggagaagagattgctaatagattattaaaacaaattattatttgcatagatactcaatgtcaaaatgaagaattttgctgtcgccaatctgccgatcattttgtaattttattggatagtgatgactttgaacaaatcaagaatcgtttatttgtgttagccaattatattagaggtgaatttgcgaaagaatataatacctcaccatattatttccattttggtgtttataaaattcttgaggatgatgttgacattaatttggctttcaagaagactcaatatactagtaatgatttaaaacgtttatcaaaagatgatgtgagcttttatcaagaagaagtttttcaaaaagagctttatgcattgcaaattgaaaaagagtttcaagattcgttaaaagctaatcattttaaagcttacattcaaccgaaagtaaatcttcaaacagggaaggtttgctcaggcgaaattttaacacgttggcatcatcctgagtacaatattatttcacctggtgattttatcccggtttatgaaaaaaacggaatgttggaagctcttgatttccatatttttaaaaaagctttggaacagatcgattattggaacaagtattatggtattaagataagtatctctgtcaatgtttcaagaacttatatttttaatgagggatatgtggataaattgattcatctggttaaagcgtgtaatgttaatcccgaacaagtagagattgaaatcacagaaacaacagcacttaatcataaagaagagttaattaagattttaaatcaattaaaaagttatcattttaaagtagcattagatgattttggaagcggatattcatccttgaatatcttaaaagatcttcctattgatgtagtgaagattgatcaggagttttttagaacaaatgactatacacatactcgcagtcatattattattgaagagataatccaattatgtcataagttaaaccttgaagttgtagccgagggagtggaaacgattgaacaaaaagagtttcttgaagctcatgattgtgattatattcaagggtattattattatcggccgatgctgctaaaagaatttgaagcattatttgtattggaaaatataaataaataaaaaggaactttattcaagctatggtacgctcctccttaagtagattttggttatttaccttatctacttaacaaggggcatatcaccatcgaataaaattccttttttattaaattaagcccatttcaatcattttaagtccaatatcaacagagttgtaagcagcacctttcattaattgatcggcaactacccataaacttaatccgttagggttatctaaatctttacgaacacgtccaacgtgtactaactcatctccaacaaataaattagccattggatagatttgattttcaatatcatcatataattcaaccccagtagaattatttagtagctcgaatactttatcaatatcgattggttttttagtttcaatatatactgattcagaatgtccccgaagtacaggaacacgaacacaagtagcattgaccttgatatctttattgaagatttttttagtttcattaaccattttcatttcttctttagaaaaatgattgtctaaatcaaatttatcaacttgtggaatgcaattgaaagcaattggaaaatgttttttatccccagcgcaaggtaatgttttggcaacaggttctttaccatctaagatttcttgagactggcggtataattcttccattcctgcaacacctgctcctgaaaccgcttgataagtagaaacgatgattctttcgatatcaaaatattcatttaaacgatttaaagcactaaccatttggatagtagtgcagtttggattagcaataattcctttatgctttcttaaagcttctccgtttacttcaggtactactaatggcacctcaggatccattctgaaatgactagtattatcaatattgacacacccagctttaacagcgaatggcatatatttttcagaaatacttcccccggcagaccaaaacgctacatcgataccttcaaagctattttctgttaattcttcaacagtaaattcatgaccttcaaattcaacaacttttcctgcactacgagctgatgctaataatttaatactttcaaaaggaaatttaaattggaagatacatcttaacatttctcttccgacggctccagtagcccccacgactgcaactttatattttttcattttttatttaccaacctttcctaaaaacgcttcatgtaataaaatttgtgcttttttaacatcgtcacgatcgatgtaacaagaaatatttatttctgagcaagatgtcatttcaacattaataccattgctgcttaatgtattatatgctttttggaacattccacgattatttttaattccaaccccaataaccgatactttaccaatgttaccacggacaatgatacgatcagcatttaactgtggttttaaatcattgataatatcaacgacagtaggaacatcaacatcactaataactagtgaaatatccattcttccgcctccaactaatgcttgattaaatacatttacattaacgccagcatcagcaattttttcaaataagcttcccgcactattgttggtggcatctactttaactaaagtgatccgcgcttcattttgtgaaccggtgattccggaaataattaattgatttaaattttctttcataatgcgctcatctcctataacatatgtccctttagtgtcttcaaatgaagaacgggcgtgaattgcaatattgtgactagctgctaattgaacacaacggtgatttaaaactttagcaccatttttagctagttccagcatttctgcataactgatacaatccaatttaagagcatcaggaactaatcttggatcagcagtgtagattccatttacatcactgtatatctctacttcactagcatcaattgctaccccaattgcaactgctgataaatcgctccccccgcgacctaaagtggtaattttaccatggatagaatgcccttgaaaaccagggcaaaatacgacatcagcgtattttaatttttcaataatatctttaccttcaaccttattgatcgttgcgttattaaaagttgaatctgtaacaattcctaattctgaattagtgattgttgccgctcgataaccgagagaagcaacttctcctttacaaactaaagttgaaattgtttcaccaatactagttagacgatcaatctcctcatctgttaactgctgggtattaacaattgataatagtgtatcagtagcatatggatcatcataacgacccatcgccgaaacaaccgcaacaactttattaccattattgatttctctaataatattgttgtacatggttgaacgtgattcacgcgaacgagtggaagtaccaccaaatttttggacaattatgttcattttatcccctcactttgaaaattgtgtattttgtatcaccaagatctgtagttagatctgctaactcaatttcatgagtaatgtagatgtgatcgtgtttttcagtgaagtacatttcataatcaacatctaatggcttatttgctctaagataatacttagatttagtaatcgggtagatgtttgagcagtcttcataatcatgatcccatctttctacttgggtagttttaattatatcacttacaactgcagaagcggtaacataacgacctgcacctttaccgtagtaaataacattttcaacatagtcattatcgatctctactacattatatgcatccatgacgtttgctactagttcttttttactaactagagtagctgcgacatcaattccaattccgttattaacttcttttgcctgagcaatcatcttaaaacgatatcccagttttttagcataatccatatcaactttagttacattacggattccactagcactaattttatcaaaatcaatatattttttaaatccattttgagctaaaatacaaattttatgggcagcatcgattccatctaaatccaatgctggatttgcttcaacataacctaggccatcggcaatggtcaaagcttcatcaaaatctaaattttcattttccattaaagttaaaataaagtttgttgttccatttaatataccaatgatttcttttgtgttgttagcgactaaactttctttttggctgactaaaacagggattccgccaccaacactagcttcgtagaaaatatggacatttttttcttttgctgccataaagatttctttaccatcatgggctaataatgctttattggcagtaacaacatgtttaccatttcttatagcttctaaaataattgttttagcgacagttactccaccaatcaattcaactacaacatcaatttcatgatcatttataacatcattaaagtcttttgtgtaaattaccccctctggtagatcaacctcttcaagaccacaaccatatttaatcattacttcatcattaatgactttttcgagacgttttctttcattagttaggatttcgataactccataaccaacagtacctagtccgataacaccgattttcatctaattcccccttatataataaaaatagacctttaaaataaggtcccaatataattaaataaatagcagaaccaatatattattgagcatgcacaataatggaactaatcgttgccataattattgcaaacatgttcattgataacatatctcggtcctccaatttcctaatttatgacatattaccacgattgtatacaatagtcaatggtaatcaataataattgaaataatcaaagttattttactttgatatgttataataagtatgtattgacttatataaataaattgtatacaatagtttaaatcacacagggggatgaacaatggaaaagaaatatataagtacacgaaaccaacaaaaagagattaatttttatcaggctatcgtccaaggaattggggaagacggtgggttattagtgccggattttgattttacaaagatggatttagatgttttatctaaattgaattatgttgatttagcaactgaagtattaagtacatttgtacctgaagaaggaaaagaattgattcatgatgcgtgtttaaatgcgtatggaaaaggattatttccagaaatcgttgtaccagtaaaaaaggctggtgatgtttatgttgctgaactattccatggacaaacggcagcattcaaggatatggcattatcgttactaccttatttaatgacgttatctttaaaacaattaaaagaggaacgtgaagtaatgatcttagcagctactagtggcgatactggtaaagcggcattagaaggttttaaagatgttgagggaacttgtatcaaagtattctatcctttggatggggtatctgcgattcaacaacaacagatggtcagtcaaacaggaaagaatgttaaggtagtaggaattcacggtaattttgatgatgctcaaagtgcggtaaaaaaagcttttgcatctgaagaattgaaagttgcaagtgatcaacataatgttttcttatcatctgcaaattcaatcaatgtcggacgtttgattcctcaaatcgtttactatttccatagttattttgaattagtaagaaataacgaaatcaaattaggagataagattaatttctgtgttcctagtggtaattttggtaactgtttagcaggatattttgctaaaaaaatgggtttaccaattgataaatttgtttgtgcttcaaataaaaataatattttaacagatttctttactactggtaaatatgatgcaaatcgtgagttttataaaacaaatgctccagctatggatattttagtatctagtaacttagaaagattggtttggtttatgtctgatggtgatggagaaaaagttcgtcaatatatggataaattaaatagcgaaggtgtttatgaagtagatgatgcaacttttgctaaaattaaagatcaatttaaagcaggatgtttaagtgaagatgaaatcttaactacaattaaaacatgtttcaatgaaactggatatttattagatacgcatactgccattggttatggtgttctaaaacaatatcagcaggagactggagaccatactaaaacagtattattatcaactgcatctccttataagttccctgaatcagtttatcaagctatttatggggaagaacttgatgtttatacagcaattgataaattaagtgaaaagactggtgttcctgtgcctcaagcattagcaggaattaaagagcgtgaagtgttacataaagaagcgattgataaaactgagattattagttttatcaaatcagaaatagaagcaatgtaggaggttagcatgaaagtaaaagtaaaagtaccagcgacaagtgctaacttaggacccggatttgacgttgcagggttggcactgactttatataatacctttacctttgaactggctgatcaaggtttaaatattactggttgtccagaacagttttgtaatgaagaaaatatgacctaccaggcttttaaacaagctgctgaaatttgtggcttagaatatcaaggcgtaaatattgaatgtagtggggatgttccttatacccgtggattgggtagtagttctacttgtattgtagcaggaatcgttggggcttttgcttttaaagataaagttgaagatcgacaagaaattctagaattagcaactgcaattgaaggtcatcctgataatgtggcaccggcaatttttggaggcttgacagtatcagtaatggaagaagataatgtattaacattaaatatccctgttaaacatgactatcggtttgttacattgattccgccatttacattatcaactgaacaatcaagatcagttttaccacaggttttgccaagagctgacgcgattaaaaacgtatctcatttagcgttgatggttgcttcattgattaatggatatgatgaggggctaaaattaggctttaaagaccgtttgcatcaaccatatcgtggtgatttaattaaaggctttaatgaaatcatgggagttttagaacaagatgaaaaagtacttggggcttatttgtcgggggctggtccaacaataatggctgttattcgtggtgaggataagatgggtgtagttcggattaaagaagagctaggtgcattaattaaagattggcaagttgtgaaattggaattagataatcgtggttacacggctgattatgaataataaaaaacgtttggaacatcaaacgttttttatttagtaaaactttttatattatcagttctttcaattagataatcaacggaggtatcatagagagttgcaagttttccaagcgtatcaggcgtcatttcgtgttgacctagttcatagcgggagtatgttttttgatcgacatgtaaatatttggctactttttcttgagtgtagccatatttagttcgaagctcttttaatcgtttgtattgcatcatatcaccgcctttttcaattatagattagtctaattaggactagaagtttttagaccaaaacggtctaaaataataaaacgctagttaactagcgccgttttttcttagtgtaatcagttttatcatcagtacgttcgatcaagtaatcaacagtggtttcatgaaatgttgcgagtttggataaaatctcaggatcgatggttctttctcctcgttcgtaacgagaataagatttttgagagacatttaaatattctgctaattgtttttgagtaaggtctttatcttctcttaaatcgcgaattcttttgtaatacataaaaccaccacctaaatttattatagagtggaccttattggtctatgcataaatgtcctaaattggactaagaaaaaattatttgcttattctttataaaagagatagattagtttataataagcacgaggtggaatatggaacagtttgcaagaattacaaggatggtaggatcttcatggatcgagtgtcttcaaaataaaaaagttgcagtttttggtttagggggagttgggagctatgtagttgaggctcttgttagaaacgggatcggcgaattagttttggttgatcatgatattattgatataactaatttgaatcgtcagttatatgcgttgcattcaacgattgggatgaataaagtagatgttgctagagcacgatgtttagatattaatcctaatctaaagatcactacctaccaacagttttatttaccagatcaaggaatggaaactatttttgaagattgtgattttgtggttgatgcaattgatactgttaaggctaaattggcactaattgaaaattgtcagcaccttggagttagagtcatttcatcaatgggaacaggtaataaattagatccaagccgttttgaaatcacagatatttataaaactagtgtgtgtccattagcacgagtaatgcgtcgtgaactaaagaatcggggcataaaaaaatgtcctattttatattcgacagaatctccgcaagaagttgacggcagtacaccaggtagtgtgagttttgttcctagtgtagctggtctgatgattgcggggtatgtaataaaagaattagtgaaggaggaagaataatggaaggaattacagaaattaataaggatgattacattgataattgtttaaaaattgtcaaagagatgattactgaagaagattttagtgatgaaatctggcttgctttaactggtgaaattatggatacatgtttatttattggtggtgattttgaagaagcaaatattcgtaatattacaaaccaatacattaataatggtggaattaaacgctttaaaaaagcgcacgaggtgttgtaatgcaacattattgtgaaattcctactccaaaaggaacgatgagaggattttttcataagccggatttagatagacatccagtatgtataatttttcacggctttaccggtcaaaagacggggacgaagttttgttatgttcaattagcaaggatgctggaagcaaaaggaatagctacatttagatttgattttttaggtagtggggaaagtgatcttaattttaaagatatgacttttaaagatgagttggcttgtgcacgtgttattctagaggaagcattaaaaatggaaaactgtactgaaatttatgttttaggacattctatgggcggtgcagttgctagtgaattagcgaagttatatccacaagtaattagcaaattagtattatgggctcctgcttttaatttaccagcagctttagattatcttactggtaaggttgagccaagttctaatggattatatgatcatggcggttatgaaatctctcagacatttgtagatgatattttggctagagatttttatgctgatctagatacatataaaaatgaattattagtaattcatggtacaaatgatacaactgtaccatttgatattagtaaaatatatgttcccaagtttaatcaacaattaaaatttgtaccaattgaaggggcaaaccataattatgatactgttgaacatattaaagaagttttaaaattatcgttggattttttaacaaagtaagtagagttatgctctactttttttgttagttaatttactaaaatgaaagtaaattaactatgattatttactaaaataatattgacttttagtgatgaaagaatatataatgatattgcgataggattgttactattagattaggcaagacctgattaaaagaatacgattaatacacttttagtgtaaggtattttataccgtgttttcgtgttgtttttagtcaggtcttttgtattggataagtgggacaataaatacattaagttataatctaaatcgctattctatacgagaaaaggagaacattatggagagaagatggagttttagaaaagttttatcatctgtagcagttgcaggaatgttaactagtatggcagcagtacctacaatttcaccagtaaatgcggctgtagatcatcaatatgatctagtagagatgaaaaaagattcagttttgaaaaacggtaattttgataatggggctactaactggaatattgcagggcaaaattctggtgttgttgctgaagatggtgtaactattggtaaatcagggaaacttggggcaactactgatttgcatgctaatggacatatttggcaagaagtgaccttgaaaccaaacactaaatatacattaaaagcaaaagttaagttttcaagcgaaaattctgatgatacaattaccttggatgttaagacgggaggattaaacgctccgaaaacatttaaggataagccaattagtcctaccaacggatgggaagaagtagaattagaatttacaacatcatcagaaacagcatatgttgttggtgttgcacgttgggtagatgggaatgcaagtgactcactgaaaaattctactgtttattttgatgatgtagaacttatcggtggagacagcgaagaagattcaaattatgatattttatgggctgatgattttaatgaatcgcaattagatacaagtgactggggatatgaattaggaagtattcgcggtgttgaacagcaacactatgtaaaaagtgacgaaaatgtatttatgcgtgatggaaacttagttttaaaggctactgatcgtgcaaaagaagatcaatataaaaatcctcgtggtaatcgtcaagtaatctataattctggaagtgtgagaactcatggaaaacaagaatttttatacggaagaattgaaatgagagcaaaattaccaaaaggaagaggagcattccctgcgttttggacattaggtgctgattttacacttgatggaaagattaatggtaaacaaggatatggatggtcacgttgcggtgaaatcgatatcatggaattattaggtggttatgaaggtgaagctcgaaataaacaagtatgggggacaccacatttttatgataaaaatatcggtgatcaatgggatcaagatacaactggttctgggggaaaagcatatacaaacccaagcggtgctgatttcaatgatgattatcatgtatttggtatcaattggtcaccagataaaattgaatggtacgtcgatggagtgatttataataccctagatttaactaatccaacttggggtgaatctgcaaaaaaatgttttaatcgtccacaatatattcaattaaacttagctatgggtggaaactggcctggtgatgtagaaactaatttagcaggaactgaatttgcaattgattatgtatattatgctcaaaatgaagaacaaaaagctgcagcaaaagaatattacgatgctgcaccagaaattagtgggttaaaagatgtaacaatgcaagaaggagcaacacctgatctattagctggtgttacatctaatcgtaatagttttgtagatttttcaattgaaaatgaacatatgtttaaaaatgaaggtggattaactagtgttgatttactttgtacaggcaaagatgatctagctagtttagcaaaattaccagttggtaaatataacattcattatactgctattccaaatgatatagaatatgatggaaatagaccagaacgtgaaagtgattataaattcactcgtaaaacgatgactttaacagttgctgaacgtactttccctagtgattttaaattaaatggaatcgttggtgataaattagcaaatgtagcattaccagaaggatggtcttgggttgatccagaaacaaaaattacaggtacagcagatgaatatgatgtaaaatatgtcaatggtgaatattcaaaaacagtaaaagttgtagttaatgcagttgtcgttgataaagaaggtttaaaagctaggctagcagaagcaacagctgaagcagctaagatagatgtatataaagctgcaactattgaaaaattaaatacagtaatcgaagaagcgactaaagtattaaatgatacaagtgctaataaagaggctgtagaagaagcagttagagctttaaatacagctatagctaatcttgagaaatatgtaacagaagcagaattagatcaagtgattgctaaaggtgaagaatttttagggaaaacagatatttatactaaagagtcactagatatattaagtactgctttagcaaaagtaagaagtgcgataacatcaggtgacaaagaagcaattgaatcagcttatgctcaattaacagaagcaattgataaattagttaaaattgatgctcctacacctgaagtgaaacctgaggtaaaaccagaaaataaacctaatacaagtgttaaaactggtgataatacatatttaggtgcaattatgacatcattgttattatctgcgggcggtttggtattgtttaaaaaaagaaaatataattaaaatagaaagatagtgctattgattatttctagcactgtctttttaaatgagttaaatattaaatagtaacagtaattaatgaataaaaataatgattaaaatggtgtttttattctagagtttttttaaaagtcaaaaatagaaaaatatatgataataaggtaatttatttgtagaaaaatcattgacattaaatatagaagtatttataatgagaatgttcttatgaactctaagtccccggtaaggatataggagaaagtaaaatgagacaaacaactatggctaatgcagccacaatcgaaagaaaatggtacgtagttgatgcaactgacttaactttaggtcgtttggcatcagaagtagcaacagtgttaagaggtaaaaataaacctacttacacaccacatgtggatactggtgattatgtaatcatcgtaaacgctgataaagtagtaatgactggaaagaaattagatacagtaaattactatcgtcactctggatggttaggtggtttaaaagttaaaactgctcgccaattcaaagaacaaaatccaactggttgggttgaagcagcggtaaaaggtatgttaccacataacacattaggtagaaaacaagggatgaaattatttgtatatgcaggtagtgaacatccacatgcagcacaaaaaccagaagaattgaagattaaagggtaagggggaaatacagaacaatggcaaatgtacaatatagaggaactggacgtagaaaatcttctgtagctcgtgttatcctaacaccaggtacaggaaatatcgtaattaacgataaaccagctaaagaatacttaccatcagacgttttattaatgattgttaatcaaccattagaattgactaacacaacttctcaatttgatgttagtgtaaacgtatatggtggtggatactctggacaagctggagctatccgtcatggtatctcaagagcattattacaagctggtactgattatagaccaactttaaaagcagctggattccttactcgtgatgcacgcgttaaagaacgtaaaaaatatggtcttaaaaaagctcgtcgtgctccacaattctcaaaacgttaattttatcaaatgtgttgtttataaaatccttgattattcaaggattttttctttttataagtaactaaacagaagtaggattaataacaatttaatcgcttgaagaagttgatatgggtataatattgttatcgaagcaatagatttaagaaggagataattttatggtaaaattaaaaagaatgttaggcgatatagatgatcctacggtggttgtattaatggctttaattgagagtcaaagtgctgaaacattagcaaattggagtttgaattacgtggaacaaaatttattaagtatttatcaagataaatatcctgatgatgcaaggttaaaacatattatttgtgaaactagaaaatatttagctggtactaaaacaaaaaaagaacaaagaatgcttttaaaagaagctaaggagcttatcaaagatgttgaggagacaattgtacctttggcaattgtgcgagcaattttaattgcatgtgcaacaaaagattcaccaacaaatgctctaggttatactttttatgctgtggcggcaatagtgtatcatcaagctggcttatgtgaaaataaagaaatatatgatcagcttgctaaagaagagtttaaaaaagtattaaaatcactgcaactgatagcaatagataatgaaaataatccagttaaagttaaatggtattgttaattaaaaaagaggtataaatgagaaatttttatttaatatataggtctatttttttttgtgttaaattgttttcatcaatattaatgttaaatcgtcaataaaaaattttttatcattactttttcataaaaattatttgcctttataattctcaatattacaaagtacttgttaataaaaagtacttttgatatacttaaattagaaaggggagagaagaaatgaaaaaggttatcatatctatatttattattttatttctatttctgggaatctcatatttttattatgtccataattcaaatgcgagaaaatacattaataattggaacattgaactatcttctaacttgaaatcactatatgagaaaaaaacagaaatcggatttcagggagacggaactatttatgaaatttttgagttagaaaaaacaagtaaacttccaaacaatttgtcttctaacaaaaatactgattttgaagcattatttaaggaatacttagttaacttgaaaattaatacaaatcaatatccagatttcaaaaatgattattattggaaatacattgaaaaaaataattccgataaattgttagtaattattaacaaaaataagacaaggctatacattattcaatctttatcataaccattataatttataagaaagaatattcaaaatctatatatttttaggtaatatttatagaaagaaggaagaatatgaaaaataaaattaagctcatccgatgtattagtgttgttacttgtatgtgcctgccgcaaactaatgtttatgcacaatcaattaatcaagaagaaaaaacttatgaattattagagcaacaaatagaatcagaacatatagatattattgcaaagttagacaaattgactaatgagtatcaagaaatacttgtaattgagacacaaaataaaaatctgaccgaaattaataagattaaagatttaataagcggtttagagaaaataaaaaaagagtacatggcttctattcaaaatacaactagagcaaatcagcctaataccgctgttgctgcagtaattggttattttagcaataaaaattataaattagcctctgaattactaatacatgctactgtaaatacaaacaaaaactccacatatagtccaactaacggcagtagagttaagtctcacagtgtatttgttaaaatagcaaatggttctaagacaaatggaagtgacattttcacaaatactggaggaactgcatcaaaggattgttattatgcacttcatagttttaactatagcaaaccgacttctagtagtaaattagttaatatctcagattattatgattatgcaagtggtgattataatggaatggaaggtattgcagtaaatgcgatgtatctagcacaacagtcgggagccatcgttccttataatgtattaatttcctaaagactataattttaaatcatctactatataactatctaaatagtaaatagatatgatacaaaataaagagctaaactgttatatgggggcagtttagctttaaattgtagatttatataaaataagttataatatccttatatataatcgaggttatactaatgagcaaaaataacgatattaataaattaaaaataataaatcaggctattaaagatacagagtatattacaacggagtattcaccatatcgtggaataattagtgtgttttgtaaatggcttatatgttattcttcaatgatgttacttatatatgtaatcgatatcttaaactttaaatttggtttttataactacaaatatttctacaatttgtataatgggggaaaagtattatttaatatatgcataaatttatatatttggaaaacaatatgtttaaaagaactatcggtaaaagagcgtaggtttttgaaattatggattattttccctattttgttttccatagaaataattatcccgatattaacaaactatctaaacactgatgcaatgatatctttttatcaaactatttctttgtcctatattatagttttaattgaattattttatatttattcctactttagaaacaagagaacaatgattataactttattgtttatatgttatattgttgtatcctttattcttaaggcttacatttatagttcaagagctatttctaattcttttggtgtttttatgaatatattttatgattttgatacatatggacttgtagccattattatgttatttactattatttttctaaagagggatacggatgataaaaggaagagaaacctttaaaatttttgaatcaaatattaggctaaaaatggttgcaggattatcaaaatctaatttgacttataatcagctacgagagctttgcaattgtagtgatggtaatatagcaacacatactaaaaaactagtttctgctggttttatagatgtaaaaaaagaatttgtcaacaataaaccaaaaacaacttacaatttgacagaatatgggcaaaaggaatttaaggagtacattaaatttttaaaaaaaattattgaagaaacagagaaataaaatgagaaaaataatgtttacattccttttaacactatcaatgataatgttaattaatatagttccgacaaaagcttttgataatgaaactgagttagacttattaataagacggattgaccatattaatgaaatttataattccaattattacattttatctgaggaagagtttattaactcagaaattacggatactttcaagtcttatgatgattatgttaaacatttattaaattatgacttaaacgaactagaaaatgaattaatagtcaatattacagttgatagtgaaactattaatgtaaatatcgaaacatattttcgttcaacttcaggaagtagaactttatcattttataacggaaataataaaatgatattaaaatataaatatagtggtagtaaatttgatacaagctataaaccaggggtaactgttactaaggtaaatactaaaaacttctttgaaatgagtagtcatactgggtcatttaagaattctaataaaacatatagcattattgcaaagggaagagtcataactccttcaggagttgtatcaaacaaatcttttacagtaaactttaatttataagaataaaaacctgttaactaaagtgttttttagttcacttcagttaacaggctttttgtatataaacttctctggtaagatgaataaagaacatcgcgtatttctttattcatctacatgtccttctatacatgattgagaaatgagaactttgggacggatacttattttcctaaatattataacaattattttttatactgtttattttaagaattctaaatcaaaaaatcttttgtagtcaattactacttcatctttgtcctcaaaagatgctagtatatattttttattgatctttgcttttactaatatactgcatctatcatctacgtttttgtatctttcagcaaaccatttagtctgttttaaagaagttgatcaagaaatacctttgtgagcatcttctattttttctcagtacttatttcccggagaaattgcgatgttatcaaaggtaagtgtcaaagggtttgttttataaactagtacgttgtttggtaaagaaaaaagttataaaaagattattacaaaattaaaaaatataaatgattataaaactgtaatattaccaataagatgagcaattggtgtgttacagttttttcataaataagagtgaatatagacatgtaataaaacggcacatataagctcgtttagaaaaattgataaaatagacattaaaatctataatgattttagaaaaaagaaagcgcttatttttttcgattgaagaggaggagagtatcatgtctaaaaaggaaaaaaattcttttgtagataagattatgggacctatggataaaatttccagtccgttaatcaaatttggtcaaattccatttattcaaggtttacaaagaggaatggtttcgtcaattggtgttacaatggttggatcaatctttttggttatttgtttatttggagctgatggaaatattacagaaaaagcattattaccgtttttaacaccatatattgaccaattgtcattaattaatagtttgtcaatgaatatcatggcaatttatatgtgtgtggcaatgggagctgaatatgctgatattaagggtattaataaaactactggtgctgtaggagcgttatttgcgttcattttattaaactataacggtatcgcagcaacttctgaaggtgtaaatgcattagaaattacatattggggtagtgcggggattgttactgctattattgcgatggcgatatctgtaaatgttattcatttatgttacaaatataacattaggatcaaattaccaagtagtgtaccaccggcaatttcagatagtttttcatctattgtgccatatttatttgttgctttaatttgttggtcaattcgtactattatgggattcgacattcctgcagtaatcacaaatattttattaccagttctttccggtgcggataacatctttgttttctgttttgcatatttctttgcctcattatgttgggtatgtggtattcatggtgataatattgtggggacagttatctctccaatgttacaaacttggatgattgaaaatacagaagcatatacagctggtttagcagcacctcatatatggattgatcaattaaatagattattccaatatgtatctacttgttggccgatcttaatctacatgtatatgagttctaaaaagttaccacaattaaaaccgctagctgtgttatcaacaccatcaatgattttctgtattgtggaacctttgatgtttgggttacctattgtattaaatcctttcttagcaattccatttgtgttaattcatactattactgctgcagtaagttatttgttaacctcaattggtttcgtaggaagatttgttataagcattccgtgggcaacaccttcgccaattttagcatatttggcaactgccggatcaattggtgcagtattattagtatttattaactttgcaatcggtatggttatcatgtatccgttctggaaagcatatgaaaagaacgaaataaaaaaattagaagagcagaaagctactgaagtagctgtttaatgaaaaggagaaattaagatgaagacttgtccatgttgtcataacgaaatactcgatgatgcaatatattgtgattattgtgggaaggaattaacaaaaaaagaagaagatgtttctagagttgttgaattaaaagagaatccccaaaaaaactatttctgccaactgggtcttatcttatttctattttcaatggttattttagatttttttatggcaactgtagttcataatactgtcggaaactctcgtattgttttctatattagcagtgttttctatatactagctttagcaactgaagggtttgcgctttttgttgattacaatgctgttaaacaaggatatagaaagaatggtaatttaggattagcgttagctactatggctttaagttcgtattttttactcgtaaatatatttggtgttattttaaaataaaggagaattctatgtattgtcgaaaatgtgggaatccgatagataacaaaacagttttttgtaaaatatgtggcgagaagattatcaagttggaacaaaaaagttatgaagaaaagtatttagaaaaaaagaaaaaagaaaaaaatgcaaaaagtgatttgaaaaagcaagacaaatattgtgatttaaagaatccatatgttatcccagcaattacagtttcgtgtattgggtttatactaggtgtttttccttatccagcagcatggaaagttggtacaagtctatggttaagtgttgttattctagtctttgcattattgggggcttatcatagtgtaaaagcaacccaagttaatagattttatgcacaaaaatactgttataccattaaagaaaaaacagttaaggtagcgagaatattgtcaacagtcacaattttagcggatctttttgtattcatgtcaagaatttaaagacaatttaaattgtctttttttcaaaggagaatataaatgagtatattattttttaagcctatacctcgtcctgcaatatggggacatacacttgtcaaagattattttgactattgcgatttcccggatggtatagggcaatcatggtcttttagcgcgcaagaaaacgcttctacagtttgtattactgaaccatttgttggtaagacattgcatgaattatggaacagtcatcaagaattgtttggtcatccaaacgaaccattcccagttattatttcattggttggtccagaagatgatttaagtattcaagtacatcccgataatatttatgctttaaaagaaggttttaatagcgggaaaaatgaggcttggtactttattgaagcaatgccaaattacaatattgtttatggtcataatgcttcaagtccagaagatttaaaggattatataagaaacgaacactgggatgatctaataagatatctagatgtgaaatctgatgattttgtatatttgccggctggattgttacacgccttgagaaaagggagtatagtttatgaaatacaacaagcaacagatattacttatcgtttttatgactatcatcgaaaagattctcaaggtaatgaacgtgaattacatttagataaagctattgaatgtctaaattatgatcaatcaaaaatggaaaataatgttcaaccaattgaaaaaaaatatgacaacattaaggaaactgtctatatatccaatgactcatttacagttacaaagttagaagtaagtggattgagtagctatatttataataactatcaactagcaacggttgttaaaggttgtggaaaggctgatggtgttgaaataaaaatgggagataattttatcattcctataaataataaagtagaatttgatggtcagatgataattatgatgaccacaaaataagaggaaagacgatgaaaaagaaagaattaagaaaagattttttatggggagctgcgttaagcaatgttcaagcagaaggtggctacctagaagatggaaagggattaaatgtatatgacacacttgttgttacacctgaacctgggattgaatctcaatatagtgatactaaggttgcaacagatcattatcatcattttaaagaggatattgatttaatggccgaaatgggcattaaagcttaccgtttctcaattatttggtcacggatacatcctaatggcgacgatgaagctaatgaaaagggattagacttttatgaagaaatgattgattatatgttatcgaagggaattgaaccagttgtttccttagttcattttgatatgcctgatcatctgatgagggcatataatggttttttaaataaaaaagttatagacttttatgttgaacatgtaaggtgtattgctaaaagaatgaatgataaagttaaatactggattacttataatgaaacaaatcttgctccatatcaaagtgatttggttgctggaactaataggcctgattatatgagtaaagaagaattttattctcaactatatattaatattcaagttgctcatgcaagggcagttttagcaataaaaaaagaaatacctgatgctatggttggtggaatggttaattattgtttgttccaacctgcaactactacttcaagggatatgatttcttgtgaattctcgcataaattcatgaattatctttcctttgatattatgacatcaggatacttaccggaatattttgtttctttcatggaaaaaagagatattgaatgtgaatttaataatgaagaacaagaggatgtacttaaggcttctaaagaattaggatatttagctatatcttattatcgttcaatgatggttacatcatatagaactattaaaaatgaatcaataatagattttgaaaacaatcttttatgggggaaaggatttgtacaaaatccattatataacgcaagtgaatggaattggacaattgatcctgatgctcttagattgtcattaattcaattacacgaacgttatcatctacctatttttattgttgaaaatggaataggtatcaaagaggaaatgattaatggtaaaatttatgatgataatcgtatagattattatcaaggacatattcaagctatgaaaactgcgattgaaaatgatggtgtagatgttattgggtatctagcttggagtagtattgattttctaagtgcccacaaagaaatgttgaagcgatatggatttatttatattaatagggatgttgaagatttaaaggacctaaagagatatccaaagaaatcattttattggtataaaaaatgtattgcaagcaatggtaatgatttggaaaataatgtagagtattagtgaggtgattaattatggttagagctcaaatttttaatcaagaaagttactgtattcaaattataagatatttatctttcttagatgattatgcaacctcttatgaaatcgcaaatcatattggaataagtaggagattagttagagatgaaattattaatgtgcaagaattattaaatgaatttggatatcgattgatttcacgtacccctaaaggatatcgtatagattttacagattatttggaggcactagagcttattaacaagattgaaaaccatgagcgtaaccataattttgattactatctatatataaatagaactttttatgttgcaaagcgactccttgaatgcgacacaggaattaagatagatgatcttgcagaagaaatttttgtatcaagatcaactttatctaaggaactgtctaatcttagagaatggtttgcgaagcatgaactgaaaataaactctaaagcaaatgtagggttgattttagaaggacgtgaagaaaacaaacgaattatattatcagatattattttcattaattacaagcactcatatattatgtttgattttttaaagagcctttataaaaataaagagatgttagattataagattatatcattgttaaaaaaatataatgtttctttatctgatacatctttaattgatttcctcgtttacatattggttatgatttcaagagctaaatctaagcatttattaactgaaattgatattccggaagagtttaacttatctattgaaatgcaagttgcaaaagagattgcattaaaaattaaagatactataaattgccagattacctatgatgagattaaacaaattgctattgaattgtttgctaaagaagataaagggtcattttattataataaagaaatgtctttaacgattgtcaatgaatcattaaaagcaattgaaaatgagttttttattatatttaaagaaccgcttttgaaagatttaaaggaagaattgtttactatggtagataagacattgtttcattgtagttttaatacaaaacagcgtaatacatactataataaagttgagaagaattactccaattcatttcaacttgctttatgtctcaagaatataatagagcaaaaaacaatccaccatgtttcgatgagcagtatatcgtcttttacaattttgttcgaaaagttcatttgtttaacaaaactccaaaaacagaaagttttatttgtatgtacgctagatcatcaaaatagagatttattatataggcagttattgtttgatataggatcgtatgttgatattgaactatttggtaatgtaggtaatattttagagtgtgacataaatcaatatgattatatcatttcaacaatttcaatggatattgatatcaatatcccaattgttttaatatctgagtttttagataacaatacaatgagatactttaaaaatcttgtaatggagacaagacaaatcgaaatgagtgaatttttatttaataagaaatattattttaattgtgttgatattgataatatcaatggaatttacgattatctctatagtgtattaaaaaaagaagtcgctatttcatttgatatatttaagaaaaacttactagacaaagatcaagtagagattattgattcatgtagccatagtcttattttttcgagtcatatgaaattaaatttaaaaaatctattaattgtatttgtactaaaaaaccctattatctataataagaaaaaagtatcaataatcattttttcgactttacaagatgattttgaaggaaatgttagaacccaaggattattgaaatcactaagatatctatgtgacaatgagcaggggtttgatcaatttattaataatcccacttatgtttgctttatcaaaggcatcaaggatataagtgtgaaaaagtgacccgctcctcattcgttggacttaatgaatgagatcgggtcattattatagacaaccatgtctattatttttcggtaattttagttgttttgattacatttaaagcttcatcaaatgagactggtcgagaaaaataataaccttgcaataaatcacagccgcattttttcataaattccatttgctccttcgtctcgattccttcagctaagatatgtaaaccaatttgattaaatgcttcaatcatttttttaataagaattgcagctttctcatctttcattgcttgccagattaggcttttatctactttaacgacttgaaaagggatagtaaggacataggtgatattagaataaccagtaccaaaatcatctagtaagaattggattccacgattaatcatatttgtcataaaatttgtgattgcatcaaaattagttaccagcatactttcggtaatttcaatttttattaattcataaggcagttgatgtttttcaataacttttaaaactttattttcaagatcatcttgcataaattgtaatactgaaaaattaatagaaacaccggtaaaatcctttttttcagcaatcactttttttataaaaagacaagttttatcaagtacctgataagtaattggagcaatcaacccattttcttcagcgattggaataaattcctcgggagaaataaacccaagtggattgtccggtaaacggagtaatgcctctgccttgcaatagctatgtgttttgagatcatagataggttgaaaataaacttcaaaactattgttttctaaacaaattcttaataagtcaagaatttgatattttcgtctaatttgtttgatcattgcagtaacacaaaaattaatattatgagcattatccttttttcctaacgaaacagcatattctaggccgttaataatttcttctttgctatgagcaactttaggataagcaattcctccagctacataactaatgataaagtcaatatttgaaatctgccacggatttttcattcgtgtttcaatcttttctagagcatttattacattctttttattataaaaaattaatgcaaactcatctccgccatagcgatacattgcctgcttaggcaataaataacgtaaataatgacaaacttctaaaagaatttgatcacctatttcttggccgaatttatcattaataaacttaaaattttttaaagaaataactacagcaataaaaggtttgttattatcgattaagatatcgatcatcttgttgaattcttgacgattcaacaaattcgttaatgtgtctgtgaacatttgcttgttttgtaaatacaaataaataattaaaagagcactagtggctgcggtacctgttaaaatatattcagggtgaatatattgaaataggattacaaaggcagaaataaaagggaatacccctaaaatataacttacatttcgttcgagagatttccttttatgaattactagaatcaatgaaaaaaagacataaatataaaagactaaatatgtaataaatatccaaggtccttgttgataaccggatacttgatcaaacgaaaagagcaacgacgtatagaaattactaaaaactaaaagaacgtataatattgatggtaaactgcaaagtgcggcatatttcttgacctctttttcatcataaatattagctagtgcatagatgaaatagatagcgcccattaacggtgtgcttaaatagtaaattagtagaaaaaagctattaaagaataatggtacttgcttataatattgtaaaagtgttgttgaaataatattagagctgactgaaagaaaagtaatgaataaacaatactgaaaaactttattttttacggttggtagaagatttcctttacgggcatagactaaaataatgcataatgttattgctgaaacaagttctgccgtgatatcccaaatcaatattttcaccacattcctataatgtattctttatagattatatcacaaatcaatcacataaagttaatagatataaagattttttgacattcaaaaatttatttaactctaatttgtgaataaaggcattgacagataaacagagagataatttaattggtagactataagtaacttaagaaaggggttattaaatatgtatgcatggcaagagattcaggtgacacttgattatattgaagaaaattatgataaagagatcgatattgataaattagcagcaattgctcatttatcaaaatactactatcagcgattattttttcgtttaactaaaaaaactgtgaatgattatgtgaagctgcggcgcttagaaaaagctgccaatcaattaaaaaatacggaaaaaagaatcttagatattgcaatagcctgtggtttttctggacatagtgcttttactcgggcttttaaagaagtctataaaattacacctgatgattatcgtaatcaaaaaattcatttagatcatttcattaaaccagatttacagcttaattatgttgtaattgatactggcgtgccattgatcgtagaagggatggttttagagataaatgaaaaacaagtttgtaatgatcgaattttttatggtaaaagcaaaatggctaaagtagatgaattaggtgaaccgaagataaataacatagtttctttgtaccaggaattagatgttcaagatgcggtagtagtagatattttaacattgagtgatgatcctgccttatttaattattttgtagggattgaaattgatagaccgtcaattgattgtgaacaacgaattattcctagtggtaagtatgtagtatgtagttatgaagcagaaaattttgaatcattagtgaatgaagctttatataaggctagccgatatttgtatgaagtttggtttgttgaacatcgtcttgaaccagatgatcttctggttcaaaaatattataatccttatcaggaaaattgttatattgaactttgggctaaagtacgatcataaaaatacatcattttaaatgacgtgttttcactttattcgcatctttatagataaatacttaaaaaacgtgtaattagttttacgcgtttttagcattattagaatcgttactgcatataatttgttaggtgattttgtgaagagaacgtatcttataatagcgattacagcagcattgtatcttgcgggacattatttttatcctaaaaatgatgtggccgtaagcaaagatttaccattaaaaaatgtatcagtagtaattgatcccggacatgggggccttgataatggtgcaagtgttggaaaaatttatgaatcggaattaaatttaaaaatttcatatgccttgaaagaagaacttgaaagtcgaggggcaacagtaaatatgactcgtgaagacgagcaggatatgaccaaacgaaatcatcactattcaaaacaggatgatatgtatttaagggttaaaaagatagattcatataaaagtgattatttaatcagtattcatttaaactcagctccagcctcaggtgcttggggttcccaagtattttattataaaaacagtgataaaggaaagcgccttgccagtgaaatacaaactacgatgaaagaagttacaggaagtgcaaaacgcatttcaggtgcagatttccgagttttacgggcaacccagacagtcggagtattgattgaatgtggttttatctctaatgctaatgaaagaggacaactgcaaagtagtaagtatcatcaaaaattagcagtcaaaatatgtgatgggattgaaaaatatcgtgagaaatatccagaagatacaattgatccaaaggattatgaaaagatattatcgtagaaaaactccttttttaagtacactctataatttagttggctgagttatggaagtgtgcttcattttataggagttttttaaatataaataataaaatatattgtcaaaaacaataaaaaaatataataaatagtaatgaaagcatttacatcttttcttgtaaatgatatatttgtgtgtataaaaaataatttttgcttataaaaagtttttaatgtgataaattaatggataaaatacaacaaattataccaaaatataaaggaaaggggtttagcaagatgaaaaaaattgttttattgtgggatacagaaataccaagtgatttttttgttgaaaagctgattgaagaatctgaaaaaggctctgtaaaatgtgaaattcaagcttattcaattgctgaagcattagaaaaccgaattgatgctgatgttgtcttgttaagtcctttgatttgttttgaacaaattaaaattgagcgtttagtacgttgtccggttgatataatcggaattggtgcttatgctttatttgatgttaaggcaattttattaaaagcatttgatgcgatgagaaaaaagagaatctaatatgtaggcaacctatttaggctgcttttttgttacttgaaattgctgattataaaattgatataggattataaggatatatatgagtgcgataatattaacagcataataatttaaattaattagaaggctattaataaatggatcgatgtaattaactaaaataattcctaaaaatccccacatcaagctatagaacatacaaatacggctagtataattgctaggtattttaccataatcccatacttctatttgtgaatcatatgataagaaaaagtgagtcaaatattctagggcagtacagccgaatagtgaataaaaaaagatttcaaaattattagtatgataagggacaatgcttaaaatcaataatgcaccaaagccatagatagggataaacggtccttttagtaatcccgatagatagaattctttctttaagattgaaacatatactgactcaagaataaatcctaaaaatgtataaattgcaaattttaccattattacctcctttaataatatatgtaattaaaagaggaatatacaagaatcttatcttaaagatgaggtatcagatacgatgaatattaatattaaaaatgaacttattatttttgatttaaaataataagttcattcaatttagtagtttttattatgttgcaatgcaagtatgttgttataaagatttattttaataattttttaatattattttcaatttctcttggctttactaacggttcaaagcgggcaacaacatcaccctcttgattaactaaaaattttgtgaagttccagtcgattcgttttgataaagtactatcttgtttttcttttaaatatgtataaagtggtgattcatttgggccgttgacttcgattttagcaaattgcggaaaactaacaccataagtatccgcacaaaaagacatgatttcttccattgttccaggtgcttgttcaccgaattgattacatgggaaatctagaatacaaaaaccataattatgatatttttcataaagttcttctaaatcatcatattgctcggtgaattcacaatcggttgctgtattgacgattagtaaaacttgatctttataattatttagtgagattgtttgattgttattatctaatacttctatttcatataagttcataattgcctcccttaaatataaactataatcaaagtataacaatatttagatatgcaaacaaataatatgcaatgacgattttttgataaaattaagaaataaaaaaaattgtcaaaattataaataaatgcttgacggtaaagaatctacatgctattatattagggcagttgattgatgggcctgtagctcagttggttagagcgcacccctgataagggtgaggtcgatggttcaaatccattcaggcccaccattagttaattgcaaatagatatatatgggcctgtagctcagttggttagagcgcacccctgataagggtgaggtcgatggttcaaatccattcaggcccaccatatatattttaatattttggggccttagctcagctgggagagcacctgccttgcacgcagggggtcagcggttcgatcccgctaggctccaccaattgtatattaagtctgctttggcagactttttaatttatttaaaggaggcaaaatatgactggaaagttgataattcttgtggtttcattctttatttattgtttaatggggtggatttgggaatcaatcattttgcctttatcacggcatcaaaaaccatataatcgaggttttttaaatggtccctggattcctatttatggttttggtgcaatgctggtaattgttttatttgatattcagcaggttaattatcctatttatactttatttattagtggcggggtagtagcttgtttattagaatatattacttcgtatgtaatggagaaactgttccatcgacgctggtgggattatagccaaaaggcttttaatttgaatggtcgtgtttgtttagagggttttatttgttttggtttatttagtgttgtggcaatcgattatgttcagcctttttttactagtaagctattattagttgatgaaaatattttatttgtcttaagtggggttttatcagttctctttattgttgatacaattgtatcaacacatgtagcattggatattgaaaagaaattagaattagtaaaacaagtactggaagaaagtgaaaatagattgattgcaagtattgaggaaaaacaaaatgaagcacgtgcatatattgaaaaacagcgtctagaatggcaaaagcagcaagtcgtcttaaaatcattaattagacaaaagaagttgtttaaatatgggcaccggcgtttgatacgtgcgttccctgatttattaaagagaaaaaaggatgagtgatgatgctgaagaaatattttggaactaaacaattctatagaactgttattagtattgcttttccaattatggctcaacagtttatcacaacgtttgtaaatttaattgataatgtaatgattggcagtattggcaatattgcattaacttcagtaacggtggcaaatcgtttttttctaattatgaactcaattttatttgggttatgtggagcggcgggaatctatattgctcaatttttcggggctaagcagaagaaaaattgccaagaggtatttaatattaatatggcttttgcggttggggcaggacttttatttacattaataatttttatttttcctcaatacgcaattgaattgttttctaaaacaccgattatagttgatgaggcgattaaatatttacatcttgctaaatatacatatatcccttttgctgtttcgttcacttgtatgatggctttacgagcagttggtattaacaagattcagctaaaagtggggatagtagcagtaataactaataccgcattaaactattgtttgatttttggaaattttggattctttaaaatgggaattcaaggggcggctattgcaacgattattgctcgacttgttgaaatggcaatatatttgattattttatatcgaaataaacatttctttagttttgatttaaaagggataattagaattaatgtcaacttattaaccagtattgttcgtaaagcaattcctttgacgatcaatgaaattttgttttcattgggacaagctttaatttttatgtcatatatgcgatgtgacgaatatttagtggcttccatatctgttgttgacacagtagctaatataatgtttattgtttttggtggtctatcttcagctgtgtcgatcatgataggaaataaattaggtgctaataaacttgatgaggctagagataatgcgcgtaaattattatgttttgcattgatggtatcgttaatgattgggatgatatgttttttattggcaccactgattcctaatctgtataatgttgatataccaattaaagaagcaatcgtaagattggttcgaattaaatcgataatgattaatatctatgcttttaatgtctgcatcttctttattttaagggcgggtggagatgttgttagtacgatgattatggattcaggttttttgtgggctgctggagtactggtttcaactctattatcgtcatttacgactatttctttaatttcgttatatatcgttgttgaaagtttggatttgataaaattaataattgcaacctacttctttaaaaaagaacgctgggttaaaaatattgcagttgtaggaggttagaatgaaaaaagataactatattattaaatcattaaatggaatggcatatggctttttctgcagtttgatcattggaacgatttttaaacaaataggaaattttgctaatattagccaactagttgcttggggtgaggtggcaacttatttaatgggaccagcgattggagcaggtattgcttatgcaatcgatgctaaaggattaaatctaattgcggcagtaattgctggaacgattggagcaggaacatttaatggtaatacggcgacaactggaaatccaatcgcagcgtttgtagccgtaattattgcagtagaagtaacaagattagtacaaggaaaaacaccggttgatattttgttagtgccttttacttctattatagttgcgggaatagtgacaatatttattggtccatatatcactaaattaattgtttggattggtgatttaattaatcaaggggtaaacatgcagccatttttcatgtcaattgtagttgcagttttgatgggaatagctttaacagcaccgatatctagtgcggcgatcggagtgatgttgggacttaatggtttagctgctggggctgctttagctgggtgttgtgctcaaatgattggttttgcggtaatgtcgatggatgataatgatattggtgatgttgtagcaattggcattggaacaagtatgctgcagtttaaaaatattgtaaagcatccgataatttggcttccgccgattttaacaagtgctattattgctccaatttctacttgtttgttggaaatatcttgttcagcaattggttcaggaatgggaactgcaggactggtagggattttagaagctgttaatgtgatgggaaataattattggattccaatcattgttattgatttactagcaccaatgttgatcagctttggaatttataaagcttttagaaaattaaactatattaaagcagggtatcttaaattagaccgtttttagttaataaataaattttaaactcttaaatttggtggatatatgtgttagaattatacataatcagggaagaaagcttcatccaacaaaaaaagggggcgataaaatgctgtttacatacaagcaaattgctaatttgaatgaaacagaaacatttatttatcgttatgtaatgaagcacattaaagttgttacaaatatgagtgttcgtgatctggctgaatgtactcatgtatcaacggcgacagtagtacggttttgtcaaaaattggattgtaatggttttgtagaattcaagacaaagttaaagttatttaatgatggacttactctaccagaaactgatgatgaaattgatgttcttttagaattttttaactatgcacgaagtgtagattttaaggagaaaattaataaatttgttaagtatatcaaggaagctaagtcgatttgttttttaggaattggaacaagtggtactttaggaaaatatggggctcgttatttttcaaatgtagggtattattcacaaagtatcgatgatccttattatcccccaccagttgatggtaatgaaagttcattattaattgctttgaccgaaagtggtgaaactcgagaagtaattgatcagcttaaaatgtatcagagtcagaatacaaaaattgtggtaatcactaataagccagggtcaacaattgatcaaatggcagatttgggaatctactattatgttaaagatattattttaccacaaacatataatatttcatctcaagttcctgttctttatattcttgagcgtgttactcatgagttacaaaatgctaaggaaaaatcgctgccgttgaagtttaccagccgtaatttataatgtggaaaactactaaaaaataagtagttttttttataaaaaaataagcaaacttgttacatttaatgtaacccgttacataacctcttgcgttcattccttcttattattaattatgttattttataggtgtaatgttaagcacattgcattgaatatcaaataatcattaagcgcttatagtatttgatattctaattgttatggattgtattgaagtaggccgctttgatacaattcaaatattgcttatatacgaaatatattaagaaggggaaatggaaaatgataaaaagattaaacaagaatttttttgcagctattctgacctttgcgatggcaattggtatgatagcacctgtaaatgttgcagcgaatgacgaatacttgaattttgatcaggattcaatttatgcaattgtttcaactacaactggaaaagcattaaatattaaaacagctagctggacatcacctgcagaagcagatggtgaatataatgctaagacaaataaaataagtaactcatcacaatttatgtttattaatgaaaatgatggttcagtaacaattaagtatactggtataaatgatgggcaagattattacttaagaacagagtctgggcaaacatatgtatgggctgatactagaaatgaagataccacagctaagtataaaataactaaaacggccgataaccaaggtattattgaaagtatgaaaagaactaatgaatatctttcaattgatagtaaaggaaaattagtctatacaagtgatagagatttggctgaaaaatttaattttgtcaaaaatcctggaattatcagtaatatcgcttggattgaaaatgtggctacaggaaagttagtaacatttgctgatcagccagatgaaaacttttctgcaattaaggtaactggagatgctggtaatataggtgatactgaaaagtttaaagttacttttcacactaatgacaatgggattaaaaatgtaatttcatttgaatcggttagtaaaccaggttatcaaattgcatcagctaagtgggtagatggcgctgtacctaccattgggtcatataaaaaagtgggtggtggctgggaagctgtcgcagttgaaccgattggaaatggattgtttgtattaaaggatgcagctacaggaaaattggttactgcaaataatgatgaagttctagaaggtggttatgaaggggaattaactgatcgagaaaaatttattatccataatgctattgatattgctgatgtcacagatttaaaagcagatgatagctcaagaactgaaaccacaattgatcttacttggacaaatccgaatagtttatatactgatgtaaccttatttaaaaaagcttcaaatgaagtagtgtttgataaagttgctgatgtaactggaaaaaaaagctatcaagtaactgatttgaaagcggggatgcaatatagttttaaattagaatatgtaaatggaaatggaaatttatcagatattaataatccgaaaaatgaaagtgctgaattgaaagttagtacaagagcaggagcaaaaccagcgacaccagcagatgttaaattagttgaaaaagatggtgagttcacaattagctggggagctgctgaaaatgcaacacactatcaattgttaagagcagatagtatgcttggggaatataatgtcgtagagactgtaactagagatagtacttctgttactgttgcacctataggtgataaatacgagaattattatcgcatcattgctctaaataatggacaaaataatgatgatgatttatcaaatgctgaaatttcggaacgttctgagtatgtatctctagaaaagaatatatttggagaacatacgttgttcttctcacccaaagatgatgtagcacaacttgataaaatattattagatttattcaatcaacaaaatgatagaggagcagatgctcaatttaaagggcaacaataccaagtttatttcaaaccaggtgattatactgaaactacatgtatgtatttagggttctatacatcatttaatggtttaggaaaaataccaatggatgttaagttaaataatatcgcaattccatcttatctagatggtaataatgctacttgtaatttctggcgttctgcagagaatctagctgttataaatactgggaatgaacaaggaaaggctggcttcgattgtaatcttgcccgaccagaatattttaactgggcagtagctcaagctgcaccgcttcgtagagtatattcaagtcgtccggttggatatgactggaattatggatgggctagtggtggatacgtagcagattgtatgtttgaaggtgtatttgaagatcaaggaaatcaattatcagctggaacatatagtggacaacaattctatactagaaatagtaaattgacaggaggcggatatggaactactttaaataatttcttccaaggtgttgatgctcctaatttaccaactgaaaaagatggtgatgctttagctaatggcaatggatattcaaattggggtaaagaagctgcgaatggggaacagcaagtattcacaaatgttgaaaaaacaaagaaacttagtgaaaagccattcctatatttagataatggtgaatataagatctttgttcctgacttacaaaaagatacatctggtacaagctggactaaagatggtgatatgggtaaagggaaaagtttatctttaagtgaattctatatagctaagccaagtgattcggctaaaacaattaatgaacaattagataaaggtaaaaatatttatttcacacctggaacatatcatgctgaagaatcaattaaggttaataaagcaaatacgattttaataggtacaggtatgacttcaattattcctgataatgatgaagcagcaatggaaattgctgatgtagatggtattaaagtagctggcttgatttttgatgctggtgaaaaggattcaaattatttgttaaaagttggacctgctaatagtgataaagatcattctgctaatccaactatactacaagatttattctttagagttggtggaactacagctaatccaacacgtgcaaaaaatgcattagaaattaatagcaacgatgtaattactgatcatttctggatttggcgtgctgaccatggtaatggtgtaagctggagtggtaatgctgctgatcatggtttgattgttaatggtgataatgtaacatgttatgcattattcaatgagcatttcaataaatatgatacattatggaacggtgaaaatggtgcaacatatttttatcaaaatgaaaaatgttatgatcctattagtcaagaggcttggatgtcacataatggaacagtaaatggatatgctgcttataaagtagctaatgatgttaaggagcattatgcagttggattgggaatttataatgtatttatttatactggtgaagattatgattcttcaaaagtgcaaattcaaatggatagtgcaattgaagtaccaaatagcaaaggtgtaattattgaaaatgcatgtttacaaacatttgctgatgaaaataaagtattacaaaaatttaatcatattattaatgatgttggtcctggtgtaagcagtggaactgataaagatgattttgctattaaaggtgaaggctggtcaagaaaattcttattaaattattgtgatggaactgctgtttatggtaagatgccagctgctgatcaaaaaggaaaatttattggaacagtaactgaagaaaacataaaagcattaggtgatgataatattgatacaaaaacattgagtgatctatataatgtgaataaggataaaaatgaaaataattatacagttgatagctggaaggtatttgtgaaagcgttagatgatgctggtaaacaattgaatgctgatttaaaatatgcatatcaaaaagattttgatagtgcaaaagatgtattgaatgatgctattgataatttagtattagttggtgctgattatagtaaagttgatagtatcaaggctgaagctgaaaaagttttagcaagtgataactatactaaagattattacacagaggcaacaagagcgacatttgataaagctaataaagcattaaatgatcttgctgatgatttaacgattttagaacagaataaagttgatgatgcaattgaattattgactgaagcaattaatggtttaacattaaaaggtgccgattatagtaaattagatgtagttaaaaaggaagctgaaaaagttttgataagtgataattatactaaaggtcactatacagaagaatcgaaagcattgtttgatgaagcttatgaagtgttaagtagtcttgctgataatttaacaattattgatcaaggtatggttgatgaagtagtaaaggcattagatactgcgattaaaggtttaacattaaaaactgaagaaccggggcaaattgtaaaaccaaatgagcctggtcaatcaacaaaaccaagtgatagcagtagtgctaaaacaggcgatgatcaaatgatttatggttatggaattgttactctccttgcactgggtggtttaatgatgttaaaaagacatcatactagctagtggagaagaattatgaaaaaaagtaaaattataaaggtagcaatactcgcactatttagtgcggtattgctcacattaaataatgtaggagctatttcaagtaatccatataatgattggaaaacttcagcgattaattatcctaataatgggcagttagttccagcgggaccaattacaataacctgggatagattaagtattgatagtcatgaagtaattggttatgaggtatatcttgataatgttcttcaaaattcaacaattattgatgaaggtgatatttttagttgtgaagtttatacaactaaagtggcacagcatcaagttaaaatattagctcaattgagcaataatactaagatttcaactagtgctagaaatttttacatatctaaaaaaggtatgggtttttatagtggtaacggctacagtgcaattcaagatgcacaaaatatgggattgtcttggtattacaattggggaacggcaccaacgtatgctggtacttgtccaaatcaaaagatagattttgttcctatgatctggggtgcctataatggttcaaacgagcaattaacaacaattaaaaatgcgggatataaaacagtattgggttataatgaaccggattttgtagatcaatcgaatgttccagtagctacagcgattgcaaatcaacattattttacaaatagtggtatgagaattggggcaccggcaacggctattcaggctcctaattctgaatggtttaatgagtattggcagggaattaatacagatgatattgattttatacctgttcataattatcctggtaatattggagttactgataaagaaattaaagacaatgctaaaagttttttaaattttattaatgaaacacataataaatttaataaaccgatttgggttacagaatttgcggtagctaattgggatccatattgggatggttataatggtgctaacgaagcgaataaagctgaagtgagaaagtttttgaattatgttattaatgggttcgataataatgtaggactaaatgatttagaatttgttgagcgatatgcctggttttcatttgatgcactagatcgttatggtggtgattcaggattatttaatactaaagcagatcatgataaaaatagcatgttaaaaattgggacattaacaactttaggaaatgattatcgtaatcttggtaatccagaaggttatatattgccgaacttaatgggggaaatagaaccgtctattgaagatgaatatgttgatgattatgttaatgtcatgattaatggtcgaagtgaaaacgtggtattgggtagtaaatttgataaaatcgatacgcctgttaaagatggatatgtatttagcgggtggtatagtgatgaggcgtgtactaaagaatatgattttgatagtattgtcactgataatgtcacaatttatccaaaatggcttaagatgcatacagtaacaattgatggtatagataataaagtaattgatggcaatacagcggttaagcctcttccttctgttaaagatggttatgtatttaagggatggtatagtgattcagaatataataataaatttgatttcaatgagccaattagaggcgatattgcaatttattcaaaatgggtaaaattggtaacggtttcggttgataataataaagtgctgattgaaagtggtacagttttatcaaggccagatatgccaataaaaaatgggtatacttttgcagggtggtacagtgatgaagcgtgtactaaagagtttgattttgctaagctattgttagaagatgtgacgatttatactaagtggaaaaaagtaattgatccaatggaaaaagaagaccaaaccacttcaattaatagtgttaaaaccggcgataattttgcaattcaaggttatgtcctaggtttgattggagtaatggtggcaattgtaatgatgcaaaaaaaatataataaataaagatattatgtatataattgactacttgataaaaaacctctcctcattgaaatttatcaaattaaatacaagtagttcaagatgttaaaagggaagtgaaggccacttccttttttgtgaaaataaaaacagtatttactattgtttgaatattgtttataaatcaacgattatgcaaagagttctttcaaaattattatcaattattttagtatttataatactgatatcttttttgtagagctctaatgcctttttttcacggcgatgcaggcatcgataacaggattcgattatttctccagtatttgtagcgattaaatagttattgcagtcatttgtcaacaattgacctttcaatagttcatcaaatatcattacctttccccctcttgttttatgatattaaaatatcataattaaaaggtaaataatataggtggaatgattgttgaaaatagttacattagatgtaacaaaaagaaggcattttagccttcttgatcgattgaaaataaagatatgatatcagctgttgacatcttagtaatactcccgtcattattttcaataaaaatatttgataaatcttgtttctgagcttgaagttcttggattttttcttcaatactgtttttcatgattaatttataaacttgtacgttattggtttgaccaatgcgataagcacggtcagttgcctggttttgagccgacatattccaccatgggtcaaagtgaataacaatcgatgctgcggttagatttagaccggttcctccggcctttaaagaaattaagaaaacatctgtattgtcattttgaaaagcgttaactaattgatgacgtttgattttattggttgccccggttaaaacgtaatatgatatatcctctttacgaagttctttttctaataaatctaaagagctagtaaatgatgaaaataatagaactttttgattgttttctttagctttctttattatatctagacaagctttcatttttgaactaggaccaataatttcattatatagaattctagcatcgcagcagatttgacgtaatcgtgtcatcattgctagaatttgaattttatcaattcgttcaacgtctaatgctgtcttaagttcgctattaatttgacttaaattagctatatacagattttcttcttctttattaaaagcaatcttaatgttattctcaatcttatcaggtaattcttctaaaacttcttgttttgttcttcttaaaataaatggttcaaccattttctttaaacgaatttgagcatctttatcttcatcgcgaacgattggacgctcaaaatgttctctaaaataattgtaattatataaatagttaggcatcaaaaaatcaaaaattgaccataactctgcaagtgagttttcaattggggtacctgttagtgcaaaacgatgagtaccatgtaactcttttactgctctggcattttttgttgcttggtttttaatgtattgagcttcatcgagaacaatatattcaaatttaaatggtttatataattcaaaatcccttcttatataatcatatgatgtaatgataacatcgtagttgtttatttgttcaatcatctttttacgaacggataatgttccactaatacataggacattgagatcgtttgagaatttttttatttcatcctgccagtttaatattagggttgctggggttattacaatactagctttgtgattctttttagcgtcttctaatacagtaatcatttgtaaggtttttcctaatcccatatcatcagcaagaattcctccgaatccataatcgctcattgttttgatccatttataaccagtacattggtaatctcttaaaatatcactgaatggttcaggaacaggataattattgatattgcagttagttagatggttgatgagttcttggaattgttggttacggttaaaattaattgtttcgctatcttgtattaattcgtttaagaataatgctttggatttatcgactatgatagcgccatcttgaatatttttgttttcaagatttaaatcttgaattaaattataggcttcatttaaagtttgatcttctaaattcacaaattcaccattttttaaacgatgataggctttgtgtttttggtatgattctaaaatatctcggatttcatcttttgaaacattaatactgtctaaatcaatctctaatagatcattttttaaacggataccaatgtttaaagaaatgtttttaggtttattaatatttttaatgtcttcactgacaaatacatcacaatatctatttaatttaggcaaaatattttttataaaatagtatatatcttcatcgttattggtgattaaatacatattcgttagttcatcatattgcgcgtaatcttcaatcattgctagtgctgtatcaacgttgagtggcagcttggtttcataactgtcaatatatttaccgtcaaataatatattaccttcatcatcacgatactcaagattgattgttaaatcaccaaagttattcaaatcaacgtaagtaagtaaagtgatcacactaggcatataatcgtcgatattagctcctgtaatggcaatataaggtaagatttgatcaatgatatatttgccaaaataaccaaaatcttcttttgcgacaatgagattttctttatctaatttagaaatcagttttttagtaattttagacattttaagactgtaacgatttaaaatgtttttgtctaaataatataaatattggttaccaataattaattggccgcctaatggcaaaagtgatatttcaaagtaatcttctttatcttcgatgttgattgttaaattatttagatcaatagtggtaaaaaacatattgatgttaagatttgtgagatatgtttcaaaaaattcatcaatattatatttgttaatatcaatagaacgatatctttcaatatcatcaataaattcgctattatcccgaataaaatcaatttgttttaatgcttctgaactaaatgatttacgattgtaatcggttgttaactgactaccgtaagtatatacattgtgataacgatagttatatatgaattctttaagattttttattaagtaagttttattttgaccaattcgataactgatcaagattcgattaaatgaataattaatattaggaattaaatcaatcaatgaatcatttgttagttgaggatcttgctgattagtgtagtcggtaattaatttttttgattcttcgagttttgtttgaattaatttttcttcacgaacgcgttcaaaggcttcaatttttgctttgtaatcaattttttgattaaactgaaaaggaatttcagacatttctaaactataaaattttaataatagtaccccaatatgaccacatgctaattcatcattatggcaataagggcaatcacattcaaaattatttatttttcctccagtatctgcgacgatatgacaagtactactacgaccatatatttcaacagtaccatcaatgtggtactcatttccctgttttagaacggacatgtttgtgattacattatctttataataactgtgagcaattttccagtttttttcattaaatatcctatttatttcatcatctttaatatacatgttctttccctccgatagaatattatatcattattttaatgattaccaaatagataacattaaaaaaagataaataaaaaaagatattttatgacaaggaataaagtgttataatatgaatgcggttacttatgccggtatagctctaacggtagagcaatccactcgtaatggataggttgctggttcaaatccagttgccggcaccataattttatttcaataactctgtctgattatttggaaaggttatgaatgaatatatacgaagcgacaaactgtattctgttagtcgctttttttgttatattaaacatgttttgaagggaggtgagattaaaatggtggctaaatcgaaaatcagtcagggaattaaaaatttacaaaataacttagggttcacacgcgatgaagcaataaaaataagctgtgacaacattacgaagtcttttcaaaaaaatctaatacctgcactgatcgaactgcaggaaaggttcagatacagttctgcttatctcgataacttgtatcaccaggagaatgaatgcagaagcagatggtatcaaggtgttaaaaatacagcatcacaaaatataaaaatgaagacgttaataaaactctctacggcgtttgaaatgtcacctggagaactgatggattacattattgattttgacaaaaagaaaaaatagcctctcggctatttagatcttacccactcggcaaagtgataagtcaaaacagataaaatccatcaatattcccagatgtcacttaagtgcagcagtgaaatattaacgagatcataatcagtaattactcaccacaaggagagagattacatgaattatcaggatgcccccgcgcaagccctgacgataccaccagtgtatcacccagtgtatcacccagtgtatcacccagtgtatcacccagtgtgccacccagtgtgtcaccctgtctgtttctaaaaaaattctatcaatttttggccgcgttttcaagtcaaaaccggcaaatagataaaataaaaatcattaaagtccctttaatgttaatttagacgaggagattagacatgcctactgcagagaaaatggtaaatcaggaaaaactatacaacaacggcaagttcgttaaatacaccacgatcaaagataaaaagtttatttatacatttataaaagaagactgctattcaaattcttctaatcttgaagctgcagtcaacagacttgtggcttatgaagatactgtttccagaagtaaaaactactgtgtttatttacaggtgatgtatccaaaggatctgtcaaaaaatgatcagcatgagtttataaaaaaattcatgtttgaaataagtctgcattataaaagactgctgtttgcttataagtttgtaagaagaggtaaaggacactacgttgatgttattgcttttgaacgtgagctttacatacgtgaacgggaaattgaagaagtctatgcccgtactatgtttataaataaaatcaccggcagaacatgcagtaaagatgatcctgaggcagtctgcagatgcaaaaagggggcagtcagaaccgatgaaaacggatgtccggtaaagaaaaaaattctgatatctcccaagaaaacaagatatttcaattataacagcagtgatgatgcagcagtgaaaaaagccaactttaataatttcagacttcgtctctgctttaaggcatcaacggctctttctaagattttcagcggataccggaatatacgtacattaaagtatgcaaaaagaagctatggtttcagcgatgtgcgaacagttaatacacagatgtataacgatgcaatcagtgatattaatagcgaactctggaaaatacagcagatattagctttaagaggggcagtgcttgataaggaagaggctcagaagcgattcgacagcatatggtacagtcttgatcacataaacagctataagacgatgaaagcaaatacaaaaaacagttacaagatcaatctttcgccaactgcatcgatcaaccagaatacagaaaaatataaagaaaccgtgaaactgttcagggatgcgtgtatggcaaagatacagcactggtatgctgtagaatttatatacagctgcaggcgtatagagaaacggactgattcaaagagcaacagtatgatttctgacaatattacatggctgatcagaaaccttacacaccttaaaaattatcaaatttcggacaatatgatacaggcagttgaaaattcagtgagcagattaaaagcctataaaaaagagaaaaaagtatttagatataatcagcagaatatcaggaacagactggctgcagttataaatgccgagaacaaggagccggtgattattgggcttttatctgttctgaaactgcagaacagaggcatatagacacaggaaaaggggtgagaaaatgaatgaatcaggaagattaatcagtgcagatttcctgctgcgactggccaatgatgatctaacttcagaggaaatcctaaaactttattttaagtactacttctgtcaggggaaaaacataagggatctaagattagactatatgagactaaggagcagagggtgcagttctgatgatcttagatatctgaatttcaatctgctttctaaagaaaagattgaaaaagcgatagatagtgtgaaagacgctgtcaatgaatttatgatcagaacttttggattggaactgaaggaaaatacatggaggtagaaaagtgaaaaaaacaggagagtacattagaaaaataattaattccaatttcccggcatatatatttctgtttattttaacagcagcactgattatagatacagcaatgattgcagtatctattgcagcgtatgcaataagcgggaatgctgcaaatcttgaaaatataacaacatatgccctgataatttcgtttgcatctacagtgaatgtatatcttatcaaaaaaataatgaaataaaaatgtaccagtgactggtacaaaatggaggaaagaaaaaatggcaaaaattataacaatcgttaaccgcaaaggcggatgcgggaaaacaacaactacaaaaaaccttggctactcacttgctaaaaaaggttataaagtgctgttagtagattatgatccgcagtgcaatactacaaaaggactgtccaaacgaaattacaggaaaacagttattgatatgatgagaggaactgatgtaagaagatgcatctataagacacggtatgatatggatatactgcccggcaatcagtttctggcatctgaagaaatagcagatcatgtgataacagatcagatgaatctgattttaagagattatgattttattattaatgatacatcaccttattttaataaactgaccgcagaaattctatttgccacagatatggcagtaattccaactgtggttgaaccggattcccttgacgggatgtcaacaacgataaatgaacttgaagaactctgtgattatgacataaaatacaagatcttatttacacaggtcaatgatctaaaaagtacagcagatgatgtaaaagtactcgatgataatctggatgatcttgtgttcgatacaaaaataagatttcatcgatatgcggtgaagagggcaagaatgaagcagcagccactggccaaaagatatcgcagagcttcggtaaccagggattatgaaaaactggccaatgaaattgtaagggaggcagattaatatggcaagcagtattttaggagcatttgaaggagtaaaaactaaaaagaagaacaaagatgatattcagtatatttattacaaagatataagatctgcaccaaaaaacagggatactggtgatattgaagaacttgcagaagatattgctgaagacggcttagatcataatctggtattaagaaaaatcgacgatgaggatcataagtatgaaatagttgcaggacacagacggtatctggcaatttgtcataacattaataagggtgattctacatatgaatacattcccgcaaaagtaaaaagctatgatgatgtggatgccgtgagacgtcttcacttgaacaatataaacgggaagccttatacaccaggcgaaatgcttactgcaatagaagaccttaaggaagtctaccgtataaaaaaagaacgcggtgaaaaaatgccggggagagtacaggaattaattgccagagatactggtctgggaaagacacaggtcggtaattatgaaaaaattatcaacaatgcagttgaaccggtaaaggaacttgtaaagaatgatgaaattactttaaatgaagcactggaaatttcggaaatggatgatgaaaatcagatgaagtttgttgaagataatgcgggcgatatatctttaacaactataaaagattataaagaaacactgtctttagaagaagatacttcagatgaaggtgaaaatgaagattacgaagagtacggtgaagatgatattaattgtgacgattttgacgatacagatgatgatgacgatgatatcgacgaaccgtatagcaagccggagaaaactgataaaagtgttactcattattcagtgtcagaattagttattgaaatccaaacaaacctatatctgctgaaaaataagataaacggtgttgagtggaaaaaagaacagatcatgcttgaggaaatgataaaactaataacagagcttaaagaatcagcaggtgtataaatagaaaagatatagtagaggggggattgtaatgagttatatagatcttttggataaaaataaaagtattcaggctgccaggcatgaaatggagcatttcagtgatctgtataaactgcacgaattcaaggatatttatgaaataggcagcggtacaggaaatgattctgttataagcattataaactgtctgaattacgatgcaaaggaaattaataaaatagacaggcgggaccgtcagcttgaatatattcaaaaagttcttaaagcgatatccaagctgagtgataaagatgagcttgaatatatctattataaatatgtgaagtttttaagaaatattgaaatcgatgaaatgttgaacaagagtccgcgatcacgagctcgtcttgcctctaaagcattgtttaatatggctcttttactgaacgtcgaagtgtatgaaggcgaggataaagcatgagagaagaacgtgtgtatctggggcacatcactgagttccaggataaaaaatattattttaaaggtacggcagagaatatcgcaaaattcattatacagaattatcagtacagcactgtaattactgataacgatggcgcaataatctgcaggtcagttgtcggaggttatctagatgcagataataaggaagtaatggctgatatattacctattttacttaaatatcagcgcggagaaaaatttacggaacttgtatttgaagagaaagaagaaagaaactattactctgaagagctaaatgtaccagtgactggtacatttagcgaaccaaaagaagcttcaggtggcaagccaacggatagtcttataaaaaggaaatattttctttatcaacgtgatttgaccgaagaacgggtgcggattctatatgaagaattaaaggggagcggatacagtgtcttaaaagtaaaaaataatggtctgtattcactgtactgcagaaagagaaaagtttttgaggggaggagaggaaatggataaatttaattcagactatgaaaaatatttagaaaaaaatggaataggtgttgtgaaaaacaactatataatctggtatcaatgttatggtacatatatagggactaaaactgtctataatcctgatatgactgattattatgaaatcccatgtgaaaagaaggttgcaatatcggagccaatagaaacagatattgtattttatacaaaaagtgaagcagaaagatactgtgaggaacatactgatgaggatgttgaatattggtttgagacagaaaagggcggggtgaacgaaaaatgagtgattacttgaaatatcttcaagaaaaacgtgcggaagtattaaaaaaaattaagccgatatgtgaggcatttggaatagaagattatgattatattgttagcgataaagggcaaacagaaatattaagaataggaactacaaaaataggatgttcctggaattctatagatgctgttgtacaggaattagtgggttacttgttcgttttttattttagagaaagagcgttagggcactttaaaacgcaggtgttcaatgaaataaaatgttactggcttaaataataaatgtaccagtgactggtacaaaggaagaggtgaaaattatgaacgaaaacaaagacaagatttatgatgatgcagacagtagaaaaaaattatataaaaaagatatattgtttaaatctgaaggacatggcgaaaagacgataattgatagagctgagtttgaaaagtgggctaaagaaaatgggaaaattattattgatcccttggataaatttatgaatacgatgaaaataattgaacttatgaaagaaaaaaatataacagtatataaattatcaaaaatgacaaattatgatcgtacaaatttaaaaaaaatattaaatggagaaataaaagagccaacaatatctactgtaatagctattgcagatgcattagaggtaaacatagatgagatagtaattaggcataactaaaaataaatatcataggggagaagtaaagatatgaaagaaatattaaaaattatttatatagcagtatgtttagcagtttgtctatatcctatatacagatggatagaagatgcagtatatgaaataggatcttatttcaaacatattcatcattcggacagttgcagtaataaaattgcaaggatagtaatttttatcagagatttatgggaagctatgtcagttgatgggcataaatattctctttccacagtaatgtttataggagtttgcgacgcaattttactttcactttttgctgcacttggttattatctgtttttgttctgaacagccataactgaaaaagcatgaataaaaatgtaccagtcactggtacattctgaagtttattattagtaaaattaaacagtctaaataatgctgtgatttcttatatactttatataagattactgttattacatataagaaaatagataatttggaaaaattataaaaaatgcaataaatataatcaacccccaactgtatacagaactatttgcagataccagtagtaactttttcttgcgcgatgcaaagattatgtcgattaaaggaattacagccaaaagtatctggccgatatttataagaacgtaagcataaatgaaattttgtggtatacctaaattggaaaagaaacttggatctttcaaaattgaaaagaaatcatcaggtacattctgtactgctaatgttacagtgttccagtaagcatcaggcataaagaaatgtgtcatgtatattgaagataaaattaaaataagaaaagaaaaaagtaaatatttatctttttgcaaatataacgatttatcttgtctgattgatcgtacaaaaaaaactttatgcaaaactaacaaagcaccagtaaaaattaataaaacaagatcatagttttgacatacttttctaaaaaacagaaaaataagtgcgataataatagttatggcgatgaccgtaattatgaataacaacaggcttgaaaaagagtcatttcctgaagaagtagtacgagaataatagtggttgtatgttgttttgtactgtttgtttgtgagatttaaagtcacattaccgttattggaaaatgaattattttttactagttggttacttaaattaccatttgtattattttgtgtaactgatttgcgagttatctgctgatatcttgtttttactgcttctttttcactgactttctttttaagaaatttgttaaggattgagtttccaacaaaatcaattaaaaaagcaacaataggtgcaaaaaaaatttcaaacattaaataaaatccacctttcaaaaatataattctattatagtagtaatattacttcgtttcaacgtcttgatagaaaaattataatgaagaagttaaattaaaaatgaaaatatagttaaacagtacagaatgagtaaaacagtttataaaaaggaagggataaaaatgattatgattattgaagcggttctggtcggtgttgccgtgtcgacttttatatttggaatgactggcttttcagtgtttatgaataagatggaggaagcggataatatcaaacagggattaaaaatgcttgcatttgctatactcagtctgttaagttgctgtgcagttatatatgttttaatggaagtgactgaaataattagaaaaataatctggtagagtttaaattgcaaagggtaaaagtatgggcaatacaataaagtcgggaaactttggagaatatgaattaaatatattcgtagaaaaaataatatttgttaatgaacagatacctgaagctggccgtgaaggaactgttctatgtaactgcggtggtaaagtacactatgtcagaaattactataataatcacttgtggtggaactgtaataaatgcggctttagttttggtcagtgatgatcttactagttataagatggaatggtgaagaaaatgaataaaattgaaaagttaaaagcggaactaagacactatgaaaagaaatatgaagaattaatagagggtcatgtacaaagtgaaattaataaggtggattccgatattaaggcaagtatatcatatattgatttaggtaggattcaaattgattataagcaatttagattttcattcagatatttcttttatacagacggcgagctttttttaagaggtaatggaaaatatatagatcatggatatggctatgcaaaagaaaagaataaagagcgtgagaatgcgtattactatgtgcgttcgatactaaaaagtgttttagaagatagttagaaaaagaggtggaatgaaaatgtatgtaatcaaatatgatagggatatttatgcaggaacatatagtgatatggatggatgttatctttatccaagctgcgacattaatatgcaaaagccgaaaatttttaaaacactaaaaggtgcagaaaagcatcttagtaacttaaaaaataaagttgtttatggaaaaaatgctgatgtatataattttaagattattgaatggtctgaaaatgatttagaatcacatttgatgagtattggagttaaacctggtaaaaatgatgatccacaaaacagtaatactatttcaccagataaaaagttagagaagtattggaaaaaagtattcaaaccattgaaaaatgaagaaatagaaattacaaatatcacagtatctgataatgtatgtacaattaattatttgatgccttattgtacaagtagcgaagaatatatattccaagctgacatagataaggaaaaagcagttggtggattttgtaacacagtagaagaaaaagcaaatgaaatgattgttatgattaaagagtgcagcaatataagaaatctattttaatagcggataaaaaagaaaggtgagtaaattaacaaaggaagaatgtaccagtgactggtacataaagaaagcaaggaaaatatagagatgactggaatgacgatctggccgtattgattgcgatagttctgacaaatcgattgattgtttttttagtagttattagcaagatgaagggagtgggtgatattaggttggaatcaaaaattcttgtatttactatgctgagtctgttaagcggttttgcaacagcgtataagtgtatattttaattggataattattaataatatgatgatgatttgaatttaaacttgcaaaggagacagtaaaaatgtgcaatacaataaaggcaataagttatgaagaatatgtaaacactccctcgttgagaaacggttataacgatacacttgtaaagtgtcatctgtacaattacgggtgtatctttgttgaaacaatactgggggttacagatgtcatggaaattgaagaagttgaatatttagatgacgtgatcaagagtgagataacaaataatcagggtacatactgaaagaattagctgctctgttagatgagtctattgaattacttgagaaatacgaaaagaagatccaggttaatggatacttagtataaaaatgtaccagtgactggtacaaatgttaaagttgaggtgaaaggaatggaaagaatagctgttgagctgtttaaaggaagacataaatttgaagatatagaaggatgtattttcaataaagagcttagagatgttaagaatatgtactatatgcaaatgtcaattaaaaaggcagtcgatgcattaatgaagagacatgggattcgtgaatatagagatattgaactggacgtctatgtaacaggactgacagtggcgcttgtagaagtgataaatttctgcagcctgtatgacataaaactggtactgtatcattacgacaaatatacaaaaaactattatactcaggatgtgtatttgaaaagacagcagtacgtttaaacagataaaaattttgcagaatgaaagatttattgcaaaaaaactttaaagacctaaaaaacggattttaacaagaaaaatatattaaaaaaatttcaaaaaagttcaaaaaaataagcttgtcaaggggtgaaaattcattggtataaatttataaaatgagaaaaaatttaggaaaacaactaatataatgataaaatttatgaaaataataatgagttggcacaaagttggcacaaaaggtggcaaaaaagtggcacaaagttggcatttacaatgactaaaaaaagtgataatatggtatcatacagaagtatacaggaaacagagatgttcctaaacagaatatatgaagtaatgtaccagtcactggtacattttttgttgtaattaatccgcctgtaaataaacagtagagaactccccatctcggcggattgatatatacagctaataattattattttctaaaaattcatagtattgaaatcaaataatatagaggtattagagtttctatactgtctaagcagattgaaaaaaattaaatagatatatataataaaattagggataaggagaatgaggtaaaatgaaggttattgaaaaatacttggatacaaaaaataaaaaaattgctgcaggtgtaactgcagcggttattattgcagctgttgggggtggtacttactgggcacttagagatacagcgccggagcttttattaaagaacagtaagacgattactgttgaatatggtgaaaaatatgaaccaaaatttgaaaatctggtcaaaacgaatggacttgataaagaagatgttcatactctgcagcataacacaaaaattacttcggatttaaaaaatgaaaaggttgaaatcaaggatgaagcaggcaatgtcacaggtgtagaagaaaaagaatatccggctgttggaaaatataccattgagttaaaatattacggggatacttttaaacaaaaggtagaggtaaaggatactaaagccccatccttgacagcacctgaaaacatagaaatcctgcagggaacggatttaaatacttttgattttaaatcactgttgccagttactgatttttctgaaataagtgattatacatttgatctttcaggtatagatgcaaatgtgccaggtgaatatacattaaaagtgtctattcaggacaaatatgaaaacaaaactgaaaaagatgtaaaagtaactgttactacatcgccggcagtagcttctgatgaggtggtagtacaggaagaagttactaatccagatgggacaaagagtataaagaatacagttaagaagaaaacagatgccggagggaataaggtagtaagcagcggttcaggatcgtcaggcggaacaggttcttctaattcgtcaggaacagcaggagggaacagcggaacgactggaggaaacacaggcggtagtaataagccttcaggtggaggatcaaccggaggaaacagcggtggttcaagctcaggtggttcgtcatcaggcggaaatactggaggatcaacgggcggaagcacaggtggaaatacaggtggaagcagtgaaaataaaccggttcaaccgccgaaagtatgggtttactgggctgaatgttattggtgccattttagaacagagtcaactgtttcatcgagggatgcagtaaataaacttgaaaatgactttagctgtacaggaaatgaatatggtatacatggaagatatcattatggtgggtatgaaaagtagttttggattaatttaaatatgtataaattaaaatggatattcaaaccatagataaggcaatcgaaagattgtcttttttatttgaatggttattcaatgtgtttgaatgtaaaacctatatcagagaagtaaaatgatgttttaaacttgcatcataataaatagtcctaagcacgacgataaaaggcaaatatagtaaaggataagcgtatttatgaagaagaaatcaatgttttctgtaatgtgcaaaacagtaatggtgctcctgacgatgttttccctgtcgtttagtaatcagatcagcgtaaaggcatgggacagcagcataccgcacgaatttaccagagtaaaaaatattcgctatccagaatggtgggcaagaaaagtaccaggcttgaggggatggagtacatattcgacaaaatataacggacagtgggcatactgtcttgaatcaagtaagaatactccaccaaacgggcagtatgttggcgaggttattgaaaataacgaagctgtaagaaaacttatgtactatggctttggaggtcccggtgctacaggagaatttgctccaggatatgatttaaaagcagcaatatgtcctaatgacagttatcttactaatgatgatgttaaatatttgctgacacatatatttttgagcggtgcctacagcggggactggaatggattcagtgagtcaggattcaatgctgcttttggaggaacatatggcactaacataatgaatatatgcagaaggatagttgcgttgccggagccgggatatgcaagatttacaccaagtccttcacaggatggaataatttctagttttactgctaatttagatatagcaaataatattcaaattacaaatactgttaaatttgatgcaggaaatggtgcaacggtcaatatacctctcaacagtgatgttactatacatattgcaggaacaacagcaacgcagactggcggtacggcagttgtatatggaggacagagtttttattttactgcccctttgaacggatcgtcggatatgcctttgactaacgtaaccgggagtcagtgtggcaggtttacagctttagcaataaaaactggttcgggttctaatcagactgaaggaacgtgggtatgggatccagatgttatgaaattatatactcagataaagtggattcatggaactgagatacaaataagcaaaagtgataattttggagaaaatgtggctaatgcaggattcgagttgaagcagtggaataaaaattcaaatacatttgaacagtttgcttctctgagctatgacgcacagaatcaggtatataaaagcggtatgcttcagcgtacagatacaaatgaaggaaaattcaggatagaagaaactgtaccagatggttacagtgaatcgagccgttatatcaaggaattcagtctctatgatgctgaggaaaggaaggtattcaatgctcagatggaagggcaggaagtaactgttaaattttcgtcaatgctgatggacaggcataatattttatttgaagtgtctggagttcctgaagcggtaacgcttgtaaagttcccgacatggtctgtggcaggaggacaggatgacattcagtggctcgaactttctaaggacagtgatggagtatggcgggcatggaaacagatgccggaagacggcgagtactatattcatgcttactacaatactgcaagtcaggaaaacaaggtaagttttacaacgtcctacaccccggaagcgcctgtaatgaatgcagttaacaaccgtattatgggtaaagtctcggttgtcaaaagtgatgaagagacaggaaaaaaactgggaggtgcagtttataacattactgcaaaaaatgatattctctcccctcagggaactgttataaataaagcgggagatctggcaggaacacttacaacggatgaaaacgggtatggtgagttaaatggtcttcatctgggacagtatattcttagtgaggtgaagccgcctgatggatatcataccggcaaagatattgagttcaatctgactgcagaaaacaactctgctgatatagtgagcagcgaactgaatgttacagaccgtccaaaccggttcaaaataaaaaaagtcgataaagatacaggcgaagcgcttaaagatgcgaagtttgaaatttatgatgctactgctgataaaacggcaggaagcctggtaagtaataaaaacggagaagcagaattgagcagactgaagccgtcgctgtattatatttgtgaagtaaaggctcctgaaggttataagctgaatgaaactaaatattattttgaaatcgacagtcttggaaatgcatcggtttcagatatgaacagtaccgaaagcagcggtgctttttttattgatgaaaatggtgatttgacagttactgttaaaaacgagatcaacttgtggaacttaagacttgttaaaaagaatgatgccggcaaaacactggaagatgcagaatttactttgtacagggataaagactgtaccgatccgattggaaaggggacaacagatgagaatggaagagtaaattttgaccgaatagtagcaggagagtattaccttcttgagacaaaggcgcctgcgggatacagaaaaattgaagatcctttaaaggtttcattaagaagcgaggatgggaaattcagtttttatataaatgatgaagcagtgaaagttccagaaggcactgaagaaagctataccctggatgtcgattatggatggtatctcattgacgaagtcacaaatgttgagggtacacacagtgcagcatcgctttgtatggtaaacacttctaatccagatatgacagtcgatataaagtcggatttcccggttattcagaaacagatccaggaagatgacaatagaaaaaatatcgggataaacagtgatggatggaatgatgtggccgactttgaaatagggcagacagttccctaccggtataattcatatgtacctgatatgaacggttatgatacgtattattatgcagtccacgataaaatgaacagtgcacttacttttgttccagacagtgtaaaagttaagataggaagcatgacgcttcaaaaagatacagactatcgtgtggttactgaaggtattgatgacggtgaaacatttcagattcagatcatggatctaaaagcggtgataaacaggtattactacagtgatgaagcagggagcaaaccggaaactgaaaaagtatatggtcaaaagattctgattgaatatgatgctgttttaaacgaagatgctcagcttgatacagggcgtccaggatttgagaatgatgtaaaacttgagtacagtaacaacccggatgctgatggtgcaggacagacaggcgagacaccatgggatacagttgtatgttttacatttagaatgaatggtatcaaagtaaatgatcaggtgccagaaagaaaactagaaggagctaagtttaaattatacagtgataaagactgtactcaggaggtatatgtaaaaaaggcttccaagagcgatggatacaccgttatcagcagggacagtgtagcaggaagtgcatcgccttcagaagcggtggaaatagtctcagacgaaaacggtgcgtttaatataattggccttgattcacaggtgtattttcttaaagaaactaaggcaccggatggatacagactattaaaggatccaatcgaaatagatgtaaaggctgtttatggagcagacaacagaacagaatacataaaaggagacggggcaactgataaaacattaagaagtttagaggcaacagctaaatttaaagagttttatacaggggtacacagtgagtatgagaaatctctatcaacaaatgtagatacgggtacatttaatataaaagtagtaaacaaagtcgggtctaaactgcctgctaccggttctgctgcaactatagtattagtctgtgcaggtacagcggttatggcagctgttctgattaaaaagaagaaaaatgaaaaagaatagtcttttcaaatttctaaaaaaggatattgtgatttttatgacaggactggcacttgtaagctatcctgtcatttccaattgtattgaatccaagtcacagactgggcagatagctacttataaagaaaaaacgactgatacagctgctgaagataagcgctgcatgattgaagatgctgaaaaatggaacatggagctgtatatgaatcaaaagggaatacctgcctccagagaatttaaatatgaggatattcttgatattggaaacggaatgatcggcagtatagagataccgtgtataaatgtcaacatgccgatatatcatggaacgagtgacagtgtgcttagtaccggagccggccatatacaggacagttcttttccaacgggtggtaaaaatacccatgcagctattacaggacatagaggactgccgtcaagccgattgtttacgcgtctggatgagcttaagacgggtgatctgttttatgtaaatgtacttgatgaaacaatggcatataagataagcaggattgaaactgttctgcctgaaaaagtcaattactctattcaggatgataaagaccttgtttctttgataacctgtacaccatatggattgaatacacatcgtctggttgttactggttaccgcatttcttataaagaatcggtaaaaaaggaaataaaaaagaatattatctcatttcgagaatttgttttttatagtctgccagttgttttttcagcagttggtatatttgtttttagaaaaaaagagatgaagggggatagaggatgcgaaaaataatcattgtagtatttatcctggtattctctgtaggatttgtttcaaagaatactgtaaatactgaagaaacaaaaaaaactaaaggctcgatagcggtatatcttgaagaaagcggaaataaaaccagtaacagtgatgttgctttaaaactgataaaagccggagaaactgctgatggtaaatatgtgctgacaggtgagcttaagacatgcggtattgatctgaatgagcttgaaacagctgataagatgcaaaaagctgcagagagtattttcagggaggcatcgactaaaaaaataagtggtattataaaacatacagacagttcaggatatgtaaaatttgaaaatctggagaacgggatatatctgcttgctgctgaagatataaacaagtatgataatatctctcctgctcttattgcagttcctgtatttgatgaggaaagcagtgaaactaatggcatgaaatatgatattgtcgtttatccaaaacactggcctgtaaccgctgctaagacgggtgataacagtaattgtgaattatatatgtctggactggcagtgatagtttttattccgctgattaaaaaagctaaaacaggaggttaagatgaaaatagaaaaatgggtattcaagccatagacagtcgaaagactgtctatttgtttttagggtatctcactgcggctgagagtaagacctgaattaaagaagtattatgatgctggctggctgaaacaattaaatacagtataggaaataatccctttggccgtaacttgcatcatctgtattaatgaaatcataaaaagataaggaggaaaaacagatgaaaaaagctgtttcaaaaatttctaaaattctgtttgttttaacgatgatcttttcaatgtcgtttgcacagatcagtaatatagaagcatgggacaatactgttccgcatgaatttacaaaagttaaaaaaataaaatatccggaatggtggggaaataaagtaccaggcctaagcagctggagtacatattcaaccaagtataacggtaagtgggcatactgccttgaatcaagcaagaaaacacctggaaacggcaattatgcagctgatgtaattgaaaataatgaagctgtaagaaagctgatgtattacggttttggaggaccgggtgatgttttaaaaacctggggacagggtgatccgaatgctcagggaaaggttggatatgactatcttaaattaagcatctgtcctaatgacagttatctgacaagtgaagatgttgcatatctgcttacacatatcttcttaagcggtgcttacagcggagactggaacggattcagtgaagcaggatttaacgctgcctttggcggaaactatggtactaatatcatgaatatttacagaaacattataaatcttcctgatattgtagagccaaaattcagtcctagtgaacaagatggcataatatcaagtttttcagcattgtatgataaaagtacaaaacagcagattacaaatactgtgacatttgaggggaattcgagctctacgatcaacattcctcttgcagacaatgtaactatttatatcaatggaaatgcagatcagactggcggtactgcaacagtgcacggcggtgaaagtttctattttacagcaccggcgaaaaacagtcctgacgatatgccattaaccaacgttacaggcagcgggtgtgagcgttttacagcacttgcgataaaaacaggaacagattcagcacagcagcagggtagttggacgtgggatcctgataattctagattatatacaaaaattgactggatggattttggtgaacttgaacttgtgaaaactaatgatgttggggatctgattgatggagcagtgtttaatttgaaatcttcatcatatgacggctatgaagaaaatattactgtaacaaatggaaaaatcaaggtggaagatctgcctgtaggtgaatatattttgaccgaaacaaaagtcccaggggggcatgcaattacacaaaagatttttaaagtaactattaataaagatgaagttactcaaagagttgtagtaaataaaataagaccaactggaaatttaaagatcaataaagctcttgaaaattctgaaaatgaaaatacagtaaataaggcagattatgatttttcaaaagtacagttcaagattaccgcagatcatgatatctatgatagtgtttctttagaaaaattatattctaaaggagatgcagtcactactggttcgggtaaaggaagcaatgatgatacagtaaaactgctaactggtactgaactgggaaatggtatctacacacctgataaagacggtaaattagagttaagcggtcttcctatgggaacatatgcagttgaggaagtgaacagtcctgaaggttttgttcttgatggcggtgctaaaaaagtacaattccaacagactgattttgtaactctgacatactttaatgaattaaatataaataatgaattaacaaaaacagttttcagcaaggtaactgctgatggggacaatctttacggtgttccaatggaaatcgtagatgccaaaactggtgaacaagtttataactggatcacagatgataatgatctagaaatcgacggattgacaactggtgattatatctggcgtgaggtaaatgctccagaaggttatgttttagcaaaacctatcgagttcactgtcaaagatggagatatccaggatattgaaatgaagaatttcagtgttgagtttgcgaaaaacggaaacgatggcaacaaacttttaaaaggaggagaattccaggtaacaagtactaaaactaaacaggtccttgataaatggacaagtggtgaacatattttcgatataactgaggatatgaaaactaaacttacatcaggtgaagttgttagtaatatgtatgttgatattgaagatgattcaagtacatattatagaatttctaaaaatgaaggacgggatgattatagacttttaatgcaggcaaatggtgaaactaaatattataacatcgatatcaacggtgatgaaacaacgcatatgatcagaggtacagctgaagatcaggaatatgttattacagagcttaagagtcctgatggatatgcaacagccgagccggttacatttaaaacagatgaagataaaaatttaactgttgaaatgattgatgagattacccgggttgaagtatctaaacaggatattacaacaaataaagagcttccgggagcgacactggttgttaaagataaggacggaaatgttattgatgaatgggtgtcaacatctgaacctcatattatcagaagcttaactgttggtaaaacatatacgttatctgagactatcgctccagacggatacaagattgcacagtctattgattttaaaattaaagacacaggtgaagtgcagaatgtagttatgtatgatgaacttttaccatcgtcaggaggagtaaatacatcagataataccagtacaggtgctatggccgccttagtgtcagtaagtacgttaggtatggtgtcatacggaatgtacgaattcttcagaaaaagatataatcagtgatcatagtaaaaaggctcggaagaatttcctgagccttttattttaaaatgtaccagtgactggtacaaaaatggaggtaacattatggatgatattctgaataaagatgaaaagtttcgatatatgctgcttgacaggatgcgcactgactgtgagtactatcttggcaacgggggtagaaatgcaagggatctctgggcaggcgatgaacagctgcaaattgaatatatggtagctctttataacagttttgacgaagattcgaaaccacagtggcttacccttgatgaaatctatgaatttaaagaacttatgtgtgataactcatataagtgattttgggagaatcggcaattaaagtgctgattctcttattttataacatgtaccagtgactggtacaaaaaaatggaggtaaaagcagtatggatgatttaactaatgaacagaaattaattcttgatgaatgccggatacttttaaaggagcacaggcagctgtgtgaagagtctgaaaggacagggataaataatgacaatgaaacagatgagctttacagcagatactggcatctcattcatgataattttgatctggagttactgaaaaaaactgaaagaagagccggtcatggcagtttcatggaacctgaatacattgatactctgatcgaggtaataaaagaacagcctaaaaagatatgcacgtacaggggatatgaacttataagaggcatagactgctggggaaatatatcatatgccccgtataaaaacggaagtcagtatggtgatgtgcttgacgggtatgacgatgaatctgctgtggcagcatttatcaaggcaattgatgatgatccaggtgatccggattttatgctatgacagacattgtaaaaagaaatatgattttttcggctgtatgccttctgctgctttcaggggtttttggaatctggtattacacagaacagaagagtgaggcatataggaatatataccttgaatttaaaaaaactgaagatgagtatgagctgggtgtgaaaatagatccggtcagctttattaaaaaaaccaacgttgatgatatcgaatttcccctcattgaggcgacaactgttggagagcatacatatatctatattgcaaaagacggctggggaaacaggaaagaatttgttttgaaattaaaatttgctgatccaactaaacctgtacttactcttacagcggactatgtggaaataacagagggtgacagtatagattttaattcttttgtaaaggaagcgtacgatgaagcagaaggttctctggaggttaaaatcgatgctcctgaagagcttaaacctggagaatatgaggtcatctatactgtcagtgacagacataaaaataaggcagaggctgttttgaaactgaaagttaatgcaaaaacacctgaaaacagtcaggattcatcacaaagggatgatatccggacaaaaaaagaagaatcaaaaagcagtacgaagaaagaaaataagaaagatgagacagcgaataatcccggtcagccggttccatcagtactgccgccatcaaaaatatttctgtttagtgaatacggctcaattgcagcggctgaaagaaatgcaaaaagctatggacagaataactgtccgtccggtcatacatggtactgcagtccttacagcgactcgtcaggaactgcagcaggatatatcgttacatttaaataaaatgtaccagtcactggtacgttttggaaaggagattatgatggtgaaaaatgaatatttaagactgtttggcgggtttaaaaaatcttatccccgctcatatgaaagaaggatagcagattatctaaaccgctttgaaaggacagtgctgtccaacagtcttgtgcagataaatattcttgtatgctttagagaaggagatgatgacatgcaggaaatgtttcctgaaatatatgaaatatatgatgagacgtgctttagaaagctgaatgattctgacataaccgcaatctgtaaaagctatgtaaataaagttagagagattggaggtgaatttatcgatgctgttaaaaaagtttcttaaaaacagggcagacgatgaaaaagaagaggaggtatctcttgaagagctgcaggaaagaaaaataaggctggtcagatctataaagcgaaaagcgatgatcaaaaggatactggtgatcctggtactgttttttggagttgcaggagggtataaggcgctgtttgatacaggagaagaaaacagttataccgaactgaaagatcaggcgtttgtaagtgcgtatattacagactattacagctatccaagaagcgatgaaacaaaggagcgtttaaagaattttacgctttcagatgatgcgtacagttatgaatatgctagtgatgtagaatcggttgatgtcagatccgtaatcatctataacattgtaaagctcgacagtataaatcagatctacagctactatataaaatgcacttatgatgtaaaggtcaaagacagcgagactgctgttaatactatgtttaataaaatcacagttggtaaaaacggtgataaatacaaggtcatacgaccggttacaaatattaagaatgaagttcaagctgtaaaagacaaagatgtcctggattcatacggctacgatcctgacaaggggtctgaatctgtggatgaggaaacaaagagtgatgttaaaaacacaattgaactgtttttaaaaacgtacaatgatgatatcacacaggcaaggctgttgtttttagagccggacagactgctgccgctcgatgacaacacttcactggagcttaacggtatgagcgatgttacaaagagtgaagacacatactatgtaaactgtacgcttaaacagacggtttcagaaatgcagatgattttaaaatatcattttgagatcgatatagaaaaaaacaaagtcaaagttatggaggtatattaattaatgaatcttttaaatacagaatttggtcgatttttatggagagtatttatcattgttatctttttgggaattatgttccttattattaaaagtgcaatggcatcatggaaacgtacggaaaaggtacttagcatgatggatgaagttatagagggacttgtagtacttgttattttctgcgtgataatggcaaatgatgcctctactgttatcggatgggtaaccacaccgcttatgtggataatcaatctgattaaaacgttcttccgtgaagtacttgggataccgttataatggccagatcagcatacaactatacacttgctgaaacacacaaaggtaaagtatatataccttatgtcgggatagaggtaaaaggatatacgacacttttttccgcggttctgggtttttttacagtaacggcggttataggatttcctttgtcctttatttttggaagtgttagttactttatagccgcagctttagcagtgtgtgcggttgttaccgctgtgatatacagcaatgagataaacaatgagacaggaagaacaaagctgaaggaattttattatctgaacataaaaaaatacaggtatgtatatgattctaagggcattaaacgttatataagacctaagacgaaaggagctgtttatgtaaatgtatgtaggaatagtacacggatacgataatattttatatcacgaagatgtagtcagttattattaccggatcaggccgattaattctctgtttgcctcagaaagccagtgtgctacgttgatcgatgacatggtcaaggtcatacaggatgtcaatatgccgggtggaattatcatcaagcctacaaaaatagacaataataagatatataaggcttatacagataattttaaagatcacggaaatccggcactgatgcatctggcaaaggattacattaaatcgttaaaggaaattctgtcttcagcagtaaggtaccgttatgaaatatattttgttttctgtgacggcagggatgaaataaagaagaagattcccttaaaactttttcgaagtgaaaaccggcctctgtcaaagcaggaactggagctgtacaaaacagtagaaaaagagatcctgaaaaagctcaaaaagacagtgcctgctcaaagaatggacagtaatgatgtaacagcactcaataattatactgctgtccccgttgatgaagtaatagctgattattatgtagaggaaaatccttctgagatcaaatatacttataaacaggcaggatcatcagtgtggaaaactctgtacagtcgtacacacgcagtatcgagttttcagacgctcaaagctgataatggcgacagagctgatgatgtgatcaacagtttacagcttgaatcttatccgtcggatctttttattaagtttgatcttgaacagacttcagagttcaagaaaaatatgaaagttaaaaaagagaaaataaaaaaggatcagaagagatatgattcactggcagatgcaaaagacagggaaatgtcaaaggcagagcttattgcaaaagcaggagaagaagttgatcccgctattgaagggtctaagataaagtttcagatgtttataaggctcagagctaatcagatcgatatgcttaataaaagaagtgaatttttaagagcaaagtttgagtcgaaaagaatactccttacaaatgaaataggggcgcagatatctatggccaataatctttttccatacagaatcagtttttctaattatatcaatacgactgatctaagattttttgcaagatataattttttaggaggtctgtatatcggcgacgaagaagaaggaatgatcataagctatacggtaccgggaggaataccaatctttcacgatatttcaaaaccgctgcttggaaaaacaaaaacaagtgctccggctattgtctttgtcggtgaaactggtgcaggcaagacacagctggcagatttagaggctttccagaatatgattttcaaaggaatgaaggtactgacagtggatccaaaaggggatcgcgagaaaaaaatcaagcttcttggcgataacgctgctcacttaaaaatcggctctaaagactgctcgtccggtatgtttgatccgtacctgatgaaccagaatgacgacagagaagcacttggccaggcgatgagagatatagacagtatgctcaatgtactgggactaagtattgatacaaacttccgtgcaatagaaaaagcgcattatgatatgcttaaagattatgaaaacaggataatacaccaaaagacacttacatatcttatttcagaaaaacttgtcaaatatgataaaacaacagctgaacaggttatgacacttgcgaatgattcgaccatgcggctgttttttgcaactcaggaaagcagatatgacagtgcattcaatcttacaaagccgtacaatcttataacctttgaaaagatgccgtcaactgccggtgaaaaaatggaaaacgatccaaacaggcttgataatgcaatctttgcgatgctgttttccagagtacaggggataattgacggttttatgaaacgtttttcaaaacaggaaacaatagttgtgtttgatgaatataaagtgtatcagaaaacccccggcggggaagaagtggtcgataatgtagtacgtcaggccagaacacttcagacacatccgtttttaataactcaggagctgtcatcaataagtgatgcgattttaaataatgtcggtgagatttttgtaggcagtctgaaatcatctaaagaaattgaatttattttagaggaaatgaaattatcaaatcatccagcagttagaggagcgttgattgatcatactcaggatgaaggggttactgaggaaaagaaatataatttcttaatgcaggattacaacaaccgcaagtgtctgaccaaaaacaagataccccggtgttttgcagagatattcaggacacttaaagatgaagaagaatctaatcaggaacaactggatacggatgataaaaatgtaccagtcactggtacatttttaaataagaaagaaacgggaggcctgtatgatgattagaaagttaaatcttagaacgataatacttattcttgcggtgttttttactgtcacggcaacagtaaatattaaaccggttgtggcagaacccccagatgaaacaacgacagaggagcttgatgaagggcgtgaaacagaaagtgacgatgtcaggttaaatacatcaaatttttattcatcagcgattatgtcgattgatacgactaccagggaaaaagaggcagatatggattatgttaagaatttttccaacagcatgataactgctctttcatatgatctgtctttagtagatcctgatacgatcctgatgcatgcattagggatcgttataaatattattgaatctatcggcgggttaatgtcgctgatggttctaattgcttataatcttgcaagcagcagtttctggaaaacaacagtagcaacaatttttaatacttttgataaggcgatttttgactggtcggatacaagcagctggttttataagataattgtactctttgggctcgtcgcagtaataaaaaaactgttaggatctatgaaacgggtgcttacatataaaacgataatttccacagttatacaggtggttgtttcatgcatagtgataattacgattgctcaaagcggaagaaatgtagtcagttatgtcgatacacttgtgaatcagtctatttcaacgagttttaaccttgtcgatgatcagtatgaaagttccgatctgcctgttgaaataaatgtaaaaagcatgatatttgatatactgcagaagcaggggttcacgctgagacatttcggggtaaccagtgcggatcagattccaagtgaatataaaggaacatataaaggaaaggactggacggcagttaaaaccggcgaggaaaggcttcaggatctgcttgacaatccttctacagaaaatgcaagaattgaaagacagaagaacggtaatgatcagatcggatacagcggggcacagtgcctgattattttaggcgagtcatttatttttcttgttcacagacttcttacagctctggtaatcggaggagcgtgtgtgctcctgtttggtttttctctggccaaagaggtcagtcttaatgtttcggtttacggactggtatttatgctgtttaaaaatgaaatgcgggtagcaagttcatggtttatggcaaggatgaagtggacaatcatgtttatttttgtgacacttgcctttaatatgtttctgtcatttatgataatatttattaatggtatcgtggcaaagtcgcttctgtttctgcttatttttgatatcgtagcagtgtacgctatgtggtatctgcttaatcactggcaggaaatctggcagaagataaccaatgatcttggcatttcatctgactcgacgattattgatgccggcaaagctattttaaacggtgacatcgcaccgggagatgtctacagcaaccataaagaacggattgcaaaagaaaaggctgaaagagaagcggcgagtgattcaacagatgaggacatggacacttacagtgaagattcagtttcaagtgtaaaggaaaatgacgaacttgcagataaggaaagttcagacgatgaaagtgatgaaggaaatgaaggctcagctgaagatgaggatactgatgtgtttgatgtggataaggagtttgacggcatagatgctgaaaatgaagaagatgctcctgacagtgacgagtcatcacctggaaacaggaatgagctgagcgagactgatgataaaaacggtttgaatcatgaaggtgaaacagatgatgaaaaaagctcaatctcatctacagataatagtgatctgaatgattcctgcgatagagaagatgatgttctggatggtgaaagtgatgaagtatccagggatgaggaatatagaaaattaccggaagaagatagagtgtcgaacagtacagatgcatcagatgagactgctgaacatgatgaaaaggttacagaagagcagaaagatgagattgacagttttttaaatgaactgatcgaggaagatgatgaaacctagaaaagtgatattcggtatttttcttgcacctatggttgtgtcggttttaatagtaattatatttatttttatgcttgttgacggtaattcatcaagcgggaacggagatattacggtttcaggacttcctcagtgtattaaagaggaaatggtgattgcaagtctgcagtgccaggagaaatataagcatcctgcatccgttacactggcgcagatcattcaggaatctactggaaaaaattcggggctttcgggtctggcatatacataccataacctgtttggcatcaaggcaggtaaaaactggactggaaagacatgtacactttttaccagtgaacagagaccggatggttcgtcgtatcagataagggcaacatttcgagcatacgattcatatactgaatcgattgaagatcgcagccgactgttaaattcaagcagcagctatccggttgagggagtaagcgatcctaaagaatttgccagatgtctaaagaaatgggctactgatatagattatcctgaaactctgattggccatatggataaatataatctatatgtgtacgataacatgtcagttgaaagttataatcagcagaagctttcaagcggaaataaggtcgtagaaaaggcaaaagagaaaatagggtgtaaatacgtctggggtgccggacactcaatgaacgaaataaaaaacccgcagttaagcacgtttgactgttcgagctttgtatgctggtcgtattatcaggcggggatagatattggcaacatgacaactaaggaactggttgttgcaggtatcgagataagtcagtcggagctcaggccgggtgatataatcctgtttgcaagaaacaagggcggtacaacaccttcacatgtttcaatatatatcggagaagggaaaatgatccatgcaccgcgcaccggtgatgttgtaaaaattgtcaactacagtgaacactggaaggacagaacgatatgcttcaggaggctgtattagtgaagaaagatattgtaaagattattttaatagtagccctcatgctgcttcttgttaactgttttgacaggcctgagaaaagtaagaaaagcagcagttataaaaatgaagaaagtgaggttttgactgataataactattacagggaacaggaagtgacagaacctatgctttttgattatgcaaatttgaattatcaaagcagtacgtatgatgaagaaacaaatacgcttgttatgaagtacgttgagacaaatgaaaaagaagaaggcgatgattacagcattcgtgcatatgagggcaaaaggaaatttaaggcttatatatataaaggcgaaacagaatatatacaggatgatgatctttattatacagagtatcagatcaggatcgttatttctgataacacacagtttatacttgaaatatccagaaacaatgcctcgtatacagtcaggtgtactgcaggatcacttgtaaactgatatgagagctaactatgtattcaagaggttatgatttgatgaggacgaaaaaaatgtaccagtgactggtacattttttggaagctgtaacaaaagaagagagtatttgatggaaaataatttttattttaagtgtacttgatatttatcggggcatattatataatgtgcttaggcaaggattgagttcaagccacggcaaataaaaaaggaacgttgcagcgttcctttttttgtgctcaggctgtcatgctatcttctatcaagccacttgcagatgcaatggcaaattacacctgctacgatagagattaaaattgagttcaatacctccacggcagtcacctccttccggtggttggagggatgacagcctgtattattatatcacggctacatttttttacaaatactgatacggtatctgtttaaaaattgttaattattataaagggaatgtaccagtcactggtacattttttatctaattataatattgtttataatttagaataaatagagcttatattatcataatataggatatgaaaaagaaaatcctacttattgaattcattatgttatatgctacaatagcatttgtaaggagtggtaatatgaagtatactttcagaaaatttaatatgatgtatgcgtcgcttaaactggtaaaaggagactactatagaactaaggaagcacgtaaggcgattaaatatatcttactgcacccatcttttttattcaaaaagaaacgggttgaatcaaaacatgattcggttttaaaagctgtaaatgttatcacaaattatccttatattgataaattatatttttcagtagttaagtaattggtatgaaaaatattgatcgattaaaaagtaaattagaaatatttgatgaaatactgtcagaaagaagaatgcattatacagtatatctgtttggtgcaggcttaggaatataccatttacatgaagattatagaatgtccagtgatctagattatatgtcgcaggatgaaatagatgatgaagatttaaagatgacgctggaaactttgaaatcagtgatatgggtggtataatgcttgttcctgaattagctgatattgaaatcgtagatagagttgaatatcagtatttaactgttctaattcctagtattgaaaattttgcattatcaaaactgttttcgtctaggccaaaggattataatgatctggaaaattatccaatactggatatgtgtgatgttgagaagttaaaagaaatgcttgaggaatacttgccttattttgtttttgcagataatccgaactataattttaattatttagatgatctgcttaataagagggggctggcttaaaaatattaataaagggaaatgtaccagtcactggtactttttttattgagactgattgtgtagaaataccggtttctttatcatataacgctgaaaattccaagagtaatattattatattgggactatgattgaattcttattatatttagtgatagtaatattaacaaatgatatacttttaatataaatatactttgttatactacagatagcacagatgatgaaatggaggggaaattatgaagaagttatttatcagttatctagtggcgattttatcaattggattatttgctgtttctacagtaaatgctgctagtgatgtttcgcagctgtttaaggagttcatggatgaatgtttcagtgacgagactaacgtaacagtatttaagggaaatcaggatgtgaccaaagaattttttgacaggtatcgtgatatgtattcaaataatgaactgctgattattagtaatgatatagagtattatggatatgatattactcatgagattgatatgcctgttataagggcaagtacaaccaaatcaaaaacttttaaatcatatgaaactaaaactgttaaaggaaataaaaaagaatggacaactattctttactgcaagtttacatataatcctggcactggaaatataacatcaatctcaaatcctcagctgaatgtagattttggctcatggggtagtgcttttacaccaagatggtttaatgcttcaactggaaaagaaaaagtgggaaggctgtctgttaagtttacatgtgattatgatgttgaagctacatatgatccaccatacttgccggcttccacgtggaattttgggcattgttcacgttcatatacacttaaggtctaatctatggaaaagtctattgttacaaagttctgtataataaatacagtatgtttagttctgtttcaaatgattcatattataattgaactactcaaaaaaaatgtttcaaatagtgtagagctaacacaatcgcaaatcatggaacaaatgaagtatagcaagatgcagagtgtttttagttatctgacgtatgcatgtatactgttaattataataattttatgtgtttcagtagttcaaaagaaatatgataatgttttattaataaatatagccggtatgtcagtgctgctgttgctgtctgtggcagctgtattgtttttaaaactaaatgcaggtaatgtttttgaaaatattttaggattaggaatactggagatattatttatagttgcttatttatacaggaggaatttttcaaaacaaaataagtgactaaaaagaatatgaatatcaagaagttctgaataaaatattattagatgaaaaattaaaatgttgcttatttgttatttgataaggtatatttgacaatgaactaagatgagaataatgtctgggttaaactgggaaaaaggacgttgacacgttcttttttattttatgacagaactcaattattgtttttggatactttttttgatacgatgcaagtttataagttgatgatttttatatagtgataagataggctgtatttataaaggtggcaggagtgaggcaaagcgcaactatgccattactatggtattggtatggtattactatggtaatggtatggtattgtaatgattttgataatgactgaggcgtgaggttttaactataattttttgtctatagatataaaattatccaggtgataataagtaataaagactatggtctttactatggtttcgactatggttaaaactatgggagatataccatagctccaaccatagtttttttcgcttgaaatccttggtatatataactttttatgctttcgaaaatctaaagaattctctcgattactatcgttttaacccttattaaactcttatagacaaaaccttatcggctcaaagcagtaaacacccatattagaccattgatactttaataaaacaatattatcaataaagaaaaaatatatatttaaaatacaaaataaatatattatataaatcagtttttaaaatgtaccagtcactggtacatttttttgaacagaacaggagagagaaaaatatgtattatcaaattattccaaaaagagattatcagttcagtcttgaaaatacgattatgctttttaagaatataggatctgcaagagagaaacttacattaaaaaatatatttgcaggtgcctttaattataaatatataatcgactgtgataaagataacagaatcaatttctatttgtggatcagtgattctgtgaatcaggatgcagctgtaaatgctgtaactgtctggcttgctaataaagctgttgtttttaaatcaaatgcagtattgaaggagtacagcgtagttgatacgctgtatgattatgaatcagcaggagggaaaaataaaaaactttctgcatttacaaatgaaacggtgttcatgaatatactggctatgcttcagccaagaacaagaatagttatagggtttagagttacagatatttcactaaaggaaaagaataatttcagatttggaagaggtggaacagatgtagagattgaagctcttattcaggtaagcggcgacagtaaatattcgagaaccaatgttatgaatattgcaggcagtatctgttcgttgacagctgatgaaagacggctcagtgtcaagttcaaaaataaatttatgccgataaaattgtccggaagtgagtttgcaaatatttttcagctcccgacattatttagaaaagatgaagatactgttaaaagaatcaattatttatttcctgggcagattaccttgaatgaagatgagtataaggaaggtatctatgtaggtaaaaattatcatccggttcaaaaagacagaaaagtgtttttggatctagatcaggcaagaaagcatggtattatatcgggttcaaccggttcagggaaatcatcggaagttgaagaaatgatagatgttttacttctgaataaattaaaaaatctaaatgcaccgggatttactctttttgatccgcttgagtccagtgccttaggtgttatagacaaaattttgaagttaagagatgatggacatgatgttgaacagctgctgaaaaaggtaagatatatagatctgtctattgataattatatatttcctgtctcgctgctgaattcaaatgtatctgatccgacggaaacattagattttttcaaatcactgtatggtgatcagaatactattcaggttgaccgcatgatgtccagtgctttaaaagctcttttagaggacagtgaggatcattctgtttttgatatgcaggagatttttaatactaatgatgatactttcaggcaggaattaataaagaggctgtctaaagatatctatgctgcagatgagattaatttccttaagaatacaagatttaaccagtctgtctcagatccaattttaaaccggctggatccttttaaaaatactcggcagaaaaagctgatgtttggccttccaaataaatttgactgtgtaaaggatattcgaaaatggatggatgaaggatatattattctgtttaatttaaagggtttgagcaaatttgatattaaagtgatctgcggatacctgacaacacagtattatttgacgtcgttagcccgtcccgatttttctatgcttcatcttctttttatagatgaagcgcatgatgtacagatgcccatctttcccaaaattggagccaagtcacgtaaaggaggactggggctgtttttaattacacagttcattgaacagtttgatccggattatttaaaacagctgatggggaatataaacacgtttatttcttttaaacaaaaagaaaccgcagcgatgactctgcagagaaatattccttcacaggatgtaagcaaaaatgacctgatgaatctaccgacatttgtgggatatttatcaactgaagaaaaaggaaaagaacaaagtattctgattaaagtcaagcctccgtaccgttatactgaaggcagactggttgatcataaaaacattactgaagtacaggaaaacttgaataagaatcgcaggtttgctcataaattgatggcaagagattttttgagcagagaagaagctgaaaaaatagtgtacagaaagcattttaaaaatctggaactggaaaaatacgagaaggaactgcttgatgagggggattcactgattcctgcagaagcaagcgatgatgtaaaaggaggaatgatgatgtgggaagattaaatcttgactacataaagtatatactgaaaaataaactgataaaaattataccttataagtacagaaaaccatttattctcgtttttgcagttttgtctttatacggttatttcaaatttatgattatgctaagtgccagactttttggaacaccaagtacttatctgctgataatgcagaatgcggttatgagtgtgcttgatatactggtgagaagttttggccaaaacggagccgctgcaataatggtgttactggcgggtatacttatatacagatatacacggccggtatataagaagaacgaaaataaaaatgaatggcattcaaaaagtttatattatgaaataaatgcggtgatttctttactgtatgttgtaattacagtacttgcatttataccgttgtttataaaatgattatggaggggatagcgttatgggtaatattaacagaccaaaattaaatgctgaagatattgaactgatgagaaaaataggagaacacaattttgtagatatgatttacatatataaattttataagacggattgtaaaaaaagaacagtaaatgaaagaatcacacaacttgctaagcatagatatcttagtataatagaaacatttataccgcctgaatataccgtaaaaaaaatgaaggggtacaaaatagtttctttgggtgctaaaggggtcgaaatcatgaaagatttaggtgctgaagttgaaactaatttaaaggcattgaaaaatgccagcagttaccgcatgtatcaccagtgtcaggttgctatggtatgtgattctctggaatatgaattcaagaacagcgaaagcaagtttgaagttgcagaaatttataatgaaaaagaaggatttataaagggaactggaaatatgccggatgctgttattctgtttagacccaaagcagagtatctgatgtctccgaaggaaagatatatagttgtttttatagaaatcgaaaggtcatatgcaagcctaaaaagatttaaatcaaaaatcagatcttatgaaaatgcaattgctgaagggacatatataaaacattttgatatatcggctatggctcagagggtactttttgtagcgcagacagacggccagtttaaaactatcctggataaaattaatgaagcaggatacgatgatatagacatccttgtatctaagtattcgcagacatgtaatgctcctgcagatagaatatatacaaatcctaaaaacggtgaaaagtataagctgttatcaaatttggaggtataataatatggaaatatttaacaacacaattgactacacgtataaatacgtgttaaaatataaatggtgggaggtattaatatgcctatgacaccaaaagaaatggtgagacttctgaagaaaaacggttttgttgaaattaggcagaaaggttctcatttaatgatgattaactatgaaattggaaaacagactactgtaccaatgcatagaaaagatttgtcaaaagggactgagcgcgcgattttaaaacaagcgggactattaaagtagtctcaccataaaatagataaggaggagttttaatgataaaagaaattatttatcctgcagtatttgagtttgatgaagaaggtgcaattaatattacttttcctgatctgccaagtgcaataagttgtgctgataatacccaagatgcataccgttatgctactgaagttgctgaactggttttagaagattatatagaagatttatttgagggagcaccaaagccttcagaaataaagaatataaatcttgaagagaatcagtgtatagcattaatcaaaattgatacagaaaaagttgtgaaggaatcgtccagtaaaagtgtaaagaaaactgtgacaattccctcatggcttaatgaagctggaatgaaaaagaaacttaatttttctaaaatactccaggatggaataaaaaaagaacttggtatttagccgataaactattcttagatacagtatctaggaatagttttattttattaacagaatgatatatgcgtaaaactgatggatagcagtctctaaaagtttaaaaagcgctaaaaaagagaatatataaattataattgcattaatagaaaattaaatctttagatacatagcggtagtggataaataataaatatttatattgataacacatgttaacacgtgttataatgtatatggtgggaggtactaatatgcctatgacaccaaaagagatggtgaggctattaaagaaaaacgggtttgttgaagttggccaatctggatcgcatttgaagttgataaaccatgagactggtaaacgaaccgttgtacctgttcatggaaaagatttgaaaaaaggtctggaaaaggcaatacttaagcaggcagggctatcgaagtagtcctcgccatttaatcagattacaggagggatgtagatgactttaccaaaaaaaataatttatccggcggttttttcttatgatgacgatggtatttgtgtttattttcctgatgtagatggatgctacagtcaaggggactctacagaagaagcgttgtatatggctaaggatgcgttagaattagtactggaagattatattccttcattgttcaaagacgctccgaagccatcagaaattagaagtttaaatcttgataaaaaccagtgtgtagctttaattgaggttgatataaaacagctgataaaaaagaattcaagcaaaacggttaataagacggttacactgccttcgtggcttaatgaagctggaataaaaaagaaacttaatttttctaagatactccaggatggaataaaaaaagaactcggtatttaaatgataatgactaggctaaaatagctgggagggtacatttctagtgaaaaaagtaatactaataattattaatctgatactggttgtaatgctgacaggctgttcaacagctgaatctgagcctgcaggtactaataataccaatgataagacacagttaataactgaaaatataccagattacacagacaaaatttatgtggaaattaatggaaataaagcagaattcagtgatgaagataaaaaacgaacagatgcttttgaactgtacactgatttagacgaatttgggcgctgcggtgttgcatatgcaaatatatgtaaggaattaatgcctactgaaaagagaggctcaattgggatgataaaaccatctggatggcagcttgctaaatatgattcggttgatggaaaatatttatacaatagatcacacttgattggatttcaactggcaggtgaaaatgccaatgaaaagaacctgatcacgggaacaagatattttaatgtagtgggtatgcttccgtttgaaaatgaagtagctgaatatgttaaagaaacgaataatcatgttttgtatagagttacacctgttttcaaagatacagaactggttgccagaggtgttaaaatagaagcatattcagttgaagacagtggtgaaggtgtagaatttaatgtatttgtctataatgttcagcctgatattgcgatcaattaccaggatggaacaagcagcggaagcggtcagattgtagacggtgtagttaaagataaagagactcatgattctgaagcagtaatagggaataaaaatactagagtatatcacgataatgactgcggttctcttcctaaggaggaaaatcgtacatattttggcagtgaaaatgaagcagtagatgcagggtatactccgcataacagttgtattaattaaatatgaaaaccttaatttgtcagttaaaagtaaataattaatgtttgagtgtgtagttcagttgaattacgcacttttaaattttataatcgttttagaatcagtttaattattaatgatgtgttaataattaaattaaaggcagttgaggtgagaatgatgagcgcagggaatatatatggctatagatctgaaagcgttttatgcttctgtagaatgtgtagaaagagaattagatccacatgaataccaatctggtggttgctgattcaactaaaacagaaaagacaatctgtttggctgtttctccttctcttaaacagtatggtatcggcggtagagcaaggctctttgaagtagttcaaaaggtcaaagaaatcaatagaaaaagaaaaaaagataacaggtatagggagtttagaggaaaatcacatattgattcagagttaaaaaatgacacaagtcttgaactgggattcattattgcccctccgaggatggcattttatattgattacagtaaaaaaatctacgaagtatatttagaatacacctcagctgaagatattcatgtttattcaattgatgaggtttttattgatgcaacgagctatcttaagactgttaataaatctccaagggaatttgcaaaaatgattattcaggatatttataagacaacgggaataacagtcacagcggaaataggaacaaatctatatcttgcgaaagtggcgatggatattgttgccaagcatgttaaagcagatgaagacggagtgcggattgcctgtttagatgaaatgagatatcggaaatacttatggcatcatcagccgattacagatttctggagagttggtaaaggatatgcaaaaaagcttaatgaagcggggttgtatactatgggtgatattgccaaatgttctgtaggcagtaaagacgagtattacaatgaagatcttctttatgatatgttcggagtcaatgctgaactgctgattgatcatgcatggggatacgaaccttgtggaggtggtttgtttgaattcgtttattccatggataggtggaaaaaaattattacgtaaagaaattataaaacgttttccaaaggaggattttacaaaatatgttgaggtgtttggcggagcaggatgggtgctttttgataaagtccaaagtaaaaaacaacttgaagtgttcaatgatatagatggtaatttaataaatttatacaggtgtattaagtttcatgctgatgcggtacaaaaagaacttgactggatcttatcatccagggaggtatttacagattataaagcgatgatagataacaatatcggtacagatattcaaaaagccgcaatgtatttatatttggtgaaagtatcatatggtgcagctcgcagaacatatggtgcaaaaacaggtataaataatactaaagagatactattagaaatacaaaaaagattatctgcagttattatagaaaataagagttatgaaaaaattataaaaagctatgacagtgctgatacactattttatcttgatccgccatattacaaagcggaacggcattatgattcacgatttactgtagaagatcataaagagcttgcaagaatattaaaggaaattagagggaggtttgttttatcgtataataatgatccgtacattaaggaattatataaaggtttacatatcgaagaaatagaaagaaataataatctttctaacaaaaattgcatatataaggaactgatcataaaaaattattaatgtcaaggaaaattacgtaatacgtaattttttttcatttttctatcccgctctaaaataatgatagaatttattccagggtgtgtatgagtgataaagatccatttatcaaaactacttggtgaaagacgaataagtcaaatagaactagcacgaagaacaggaatacggccggcaacaataaatgaaatttattgggagtttgcagagagagttagtctggaacatatagacattatctgcaaaatgttagggtgcaaaattgaggattttatggaggtggtatatgaagataatgataaaaataagtagttgaatgtactctgagaatgagtactttttttgtgggaggtaaagtgatgaataaaataaaatttaatgaaattattaatgagtatttatcttttaaaagaatgtatgtaagacataatactatgattagctatgaagaaagaataaataattacatattgccttattttgctgattttgacatattttcgataaccaaagaagatatcataaattggcaaaaagatttgtttgaaaaaggtgtatcgattaaatatataaataaaattcgaccagtgctgcataatatattttcttatttatgtgattatcatggctgcgataataatcctgttactcatgttcctaggttgagggataattcaccgtatgaagagatggatttttgggagtttgaagaatttaaaaaatttgctaaatcaattgatgatccactttattataggttttttatgtttttgtactatacaggtgctcggaaaggtgaggcaagggcaatgacatggaaacaaatagattttaaaaataatttgattactatttccagaagtttagaacgaagaaaagataaaaatggaaattatataattaataggcctaaaaatgatcatagcaggactataatgttaaactctgaattaagagatgtgctattaatatattattcagaacggaaaagacattttgattttgatgaaaaagagtatttgttcggaataaaaaaaccgttggcggactctacaatagaaaacaggaagaataaatactgtgataaatctggtgttaagaaaataaggatacatgatttcagacatagcaacgtttcattgcttgtttcgttgggggcagatatatgtgttatctgctctcgtctgggacataaagatagaaatcagacacttaacagatattcgcatatgtttcctagtaaagaaggagaaatcgtagataaaattgataatcaagctagtatctataactcatattccgtaacattggcaaatgttatagtagattttttagagaaagtaaatcaattgaaaaatcttgaagaaaaagacataattatgatagatcaaataaagaaaattatataattataaacggatattgcaaaacactaaaatgtatgctataatttccattgtaataggtgtgtctatacgtttttctatagataccataaagagtaatattaattagcaatttaaattattgaatgggtattggttagttttaaataaaatacagattccagttgccggcaccataattttatttcaataactttatctgattatttagaaaagttatgaatgtctatatatgaagcgataaactgtattcaatttgtcgctttttcgttttatcatattttaaaagaaagcagaaaattaataaatgtaatataaagttgtaatcgattttataaattcaaacatttaattatagattgattttttaattacatgaagaatatgtgaagaagtagattatgattattatatatatctaattttatttgatgatgaaattaagaatattatacaggattttaaaataaatgatggttctacgtatacagatgcaagttctttgacagagggaatgatggactaaagaattaacaactatagaaaaagcttttaggtttgattagataaaatgtgtatatgctcaaattttactagaatatcatctgattaaaaatgatatttcaagatatataaatattttatgtacattagctgattttaaatgtatacgataatttaaaaattaataatatcattgatagttatcatatattattgacaataggttaaataattgttattatattggtgtaaaattgaacagaaggattgtaactctttgaggcatgacctattatttaggataatgaatcaaagagtttttttgtataaaaggaggagttaatatgtttaaatttatgaataaacaagatggaggaattgtttcaccaatagatggaaaatgtataaatatagaggatgttccagataaagtattttcaacaagaatgatgggtgatggctttgcaattattccatcagataatattgttgtttcacctgttgatggaataattgttatgataccaaatagtaaacatgcatttggaattaaaactagaagtggggttgaaatattagtacacgttggtttggatactgtaaacttaaaaggtagaggatttgagatatttgtcaaagttggcgataaggtaaagaagaatatgcctatattaaaatttgatgataatattatggatgaaatgaatatagataaaacaactatggttatatttacagcaggttataatcaaagtataaaattagaatgttatgatagggaagttcatagaggagatactttgattaaatagaaggaggaatacttcgtgaaagtcatcaaaaaaataaataataatatagcaattgcagttgatggtgaaaacaatgaagttattgtatttgctaaaggaattggatatggaaatattccctatgaaataaaagatctctctgttattgagcgaaccttctatgatgttgacaatagatattatggtctacttaaggaaataccaaataacatttttaacttagttacaaaaatggtggatgttgcaaaaaagaatattgaagatgaattaagtcctaatttagtgtttattttagctgatcatattaattttgctattattagggagaaaaatggtatggatatttcgttaccatattcttatgaattagagtatgaatatccactattaacaaaaatatcaaagtggatggtaaaaaaaactaatgaggaattagatactcatttaccaaaaggtgaagttacaagtataactatgcattttattaatgcacttgaaggtacaaatacgaaaatgcatgcaggtaatattgaaaataagatatcaaaggttatctttaatgttactaacatagtagaaaaacattttaattttaatatagacaagaagagttttaattactttaggtttaaaaatcatctaaaatattttgttcaaagaaaagaagctagagaaatgttcacagataacaatcgtgaattatatgagagcatgatagaaaagtatccagatacctatgattgtatcagtaagatagataactatttttatcaggaatataaagaaaaatgtacgactgaggaactattatatttattagtccatgttaatagattgtatataaaagaggattgtcaccgaaagggcatcaccccagaaaagtaatactttgatggggttttattttactcattacattatttggcgcgcaagataatgttttgtatataaaaaggaggagaaaaaatggcaaagaaatatgaaaaacttgctaaaacgattttagattcaatcggtggaaaagaaaatattacatattttcaacattgtacaaccagattgcgttttaatttaaaggacaggagtattgtgaagatatctgatatagaaaatgtagatcaggtattaggaagtcaatggtccaatgatgaattgcagattattattggacccgcagttgctgatgcttatgcggaaatttgtgagtttggcaatctccaaagagaagaagcaattgatgaagatcttgatggaaatgcagaaaagaaaaaagtcgctttaaaatctgtacttatgggaattatggatgggatatcaggatgtatcacgccgattattccaatgatgattggtggaggaatgatcaaagtattctatatgcttgcgaatatggtaggaatcttgcctgaaacaagctcaacatatcaaattttatattggttgggggatgcttttatctatttctttcccgtttttttaggcgcaacagctgctaaaaaatttggagcaaaccaaggtgtaggaatgttgttaggtgcattgcttatttatccaagttttattgcaatggcaactgaaggagctgctatgtcaatttttggattaccggtttatgttgcaaattattcaactaccgttattccaattattttaactgtttatattttaagtaaagttgagaaactaattaatcgatattgtccagatattttaaaatcatttgttgtccctacaggttctttattagtcatgttaccaattatgttagtagtaacggcaccgttgggatactatattggaacttatgtggcagaagcggttatttggatttatgaaacaattggtttcttaggggtttctattttgtgtgcattgttacctttaatggttatgactggtatgcatacaatgatgacaccatattggacttcggccttcgcctctttaggatatgatcctttctttttaccagctatgattctttctaatatgaatcaatttgcagcgactttagcagtatcattaaaagctaagacaaaaaaagtaaaatctactgccatgtcgtgtgcggttactgcaattgttggtggggtaacagaaccggctatgttcgggattacttttaagtataaaaaaccattgtatgcagcgatgattggaaatgcagctggaggattaattgctggactattaaaagttgcctgttatgcatttccaggatcaggaggtatgtttgcagtagttacttttgcgggtccaggaaataatttgatattctttttaattgctgcattggtaggaatgattattacatttatattaacttatattttaggaatagatgagaaagaggtgtagggagtggcttttccaaagaattttttatggggtggcgcaacggctgctaatcaatttgaaggtggttggaatgaagatggtaaattagattcaactgctgatcactttacattaggctcaagaacagagccaaggttattcactgaaaaaatagatgaggataaatatttttatccatcacataaggcgagtgatttctaccatcgttatcaagaagatattgctttactgggtgaaatgggatttaaggtttatagaatgtcaattaattggagccgtattttcccgcatggtgatgatgaagaaccaaatcaaaagggaattgaattttataggaatgtatttttagaattgaaaaagtataatattgaaccacttgtgacaatttcacattatgaaatgccttatcatttagcagaaaaatatgatggctggtatgcacgtgaaacaatagatttttatttaaaatattgtcaaacacttttcaatgaatacaaaggacttgttaaatattggctaacgtttaatgaaattaatagtttgattcttggaggtaatggatatttctctggtggaattctttcgtcatcaaaaaaggacatgggagctggcgttattgaagatttagatacgttatcaacagtagaacaacataatgatattgtgaaacaatatcaagcattacatcatcaacttgttgctagtgcattggcgaccagaatggctcatgaaattagtggtgaataccaaataggatgcatgattgctggaattacacaatatccatattcttgtcgacctgaagatatgttattagtacagaaagaacgtagaaatattttctattattgtcctgatattcaaataaatggagcatatcctcgctatgcacatcgttatttgaaggaaaacgatattcatatcaactttggggagaatgacgaagatattttaaaaagcggaacagttgatttctttaccttttcatattattcaactggttgtgtaacaacagataaaaatttagaaaaaacaaatggtaatttaatatttggagttgctaatccatatctagaaaagagtcagtggggttggcagattgatcctttggggttacgttattttttaaatgaaatatacgaccgttatcatattcctattatggttgttgaaaatggattaggacaagatgataaattagaaatagataaaacggttcatgatgattatcgtattgaatatatgaaacaacatattcaggccatgtctgaagctgttgatgatggtgttgaacttgttggttatacaccatggggatgtattgatttagtggctgcatctactggcgagatgattaaaagatatggttttgtttatgttgatgtagataatttggggaatggaacatataatagatataaaaaagattcattttactggtataaaaaagtaattgcttcaaacggaagaaaattagattaagttaatattctgtttattcatttataaagttcattgattctttaaattggaattaaccataaaaaaagatgaacaaaagttcatcttagtgtttcaaatggtgacccgcaggcgattcgaacgcctgaccctctgattaaaagtcagatgctctaccggctgagctagcgggtcatagacacttaacagtgccatataaaaataacatagttttgaaataatgtaaagctattttgggaaaaaataaattaatttagcaatgtttttcttataatgatgaaaattgttataattattcagcataaagagaacatgaattagtaaaagaactagctgatataataaatagtcctaaagattttgatctttaggacttctttttgcttgggcgggaaggtcatatatttttcgtagctctgagatcgtttgatagattttaggtttataagtttttaaagcatttttttgataatatagagaagcaattttttgatataaatcataattatatttttttatacaattaaggaaatagggtttagtttgccctcgtaaatagagagtaccgggtaacacataatcagcatttactttttttgccattttatataatccatttaaatttccgggttgatcagtgagataagggataattggcataatgtgaataccagcatgagctttagtttcctttttgatttggtcaattactttaaatcgttcaataataggtgaacttcctggttcgatgattttacgtaagtcatcatcaacagtaataatagtacaagcaatattaacataggttatttttgataattcattgattagttcaatatcacgaaggattaatgatgatttggtagaaataataataggtgttttatacttaatcattaattttaaaatttctggcattatttgtaattgttcttctaaaggctgataactatcacaaacacccccaatattaactaattcgtgtttccatttaggtgatgataattctttttctaaacaagataaaatattctctttataatagatcgtgccaaaataatcattgttgtcaaggtatttatgactgtaaatagcataacaataaatacaaccatgttgacagccgcgatagatatttaaatcccacttaaagggaaatcgcccactaactttatttaaggcgcttttagattctaatggttgatatttcattttatcaccttctgatttaatcataacatattgcttgaaatatgtatgtaaagaatcgttgttgggaatattaattctacataattctaataattgttatgattaaataaaaataaaaaggatgaatggtgatgaagactaaatatgtgctagtattgatggcaatgatgtttgttattagtggctgtagggaagaggtaacaaaggaagtaggagatacaacgattaatattgcagaactaaatggcaaaagagaaattgataaaaacgataaaatatttgcgaataataatcaggggaagcatgatttattaatgttgatggctaatagtgtggatcattataatttaattagtggaacaatgctttcaacgttaagctatcaaggacaaaaaagtgaaagcaagtatatttttcaagttaatgttccagaatatcagtcatatatttatttagttccttcaaaaaatgaagaaagccaagtaacttttagagatagtgaaagaatgtatttttttgttggagatttagtgagtttaaataataacttagatgaattaatcaataagcaaatgatgacagttgaggatgtaagtaaagatgatagcttatttaaatataaagatttgacacttgaggaaagggttgaaaatatggatattagtcgagtagctaatgatttgtttggcgatgtagcaccatatttattacctgaagatattgcactcagacaaataggtactgcttataataattatgaaataaagggagaagaaaaatatcttaatcgagatacttatagagtagaggggaaaataaatgatagtctctataatagtgatagcactttttctatgttggtcgataaacaaactggaattgttcttaaatatactaggactacaaaagatagtctggtagagatgaagatggaaggtatttcgattgatgaaatgaatgaagagaatatgtatgctaaatatcttagtcaaaagtagaatttttactacttttttcttttttgataaaaaaataaatttttttcataaaaagggttgcatcattctagggataatgatattatattagggcactaagttgcttgaatagctcagttggtagagcaatcggctgttaaccgatcggtcgtaggttcgagtcctacttcaagcgccatggcctgttggagaaacggttaactcacatgcctttcacgcatgcattcacgggttcgaatcccgtacaggtcaccattatggaggtttagctcagttgggagagcatctgccttacaagcagagggtcagcggttcgagcccgttaacctccaccatttttgttataagccggcttagctcaattggtagagcaactgacttgtaatcagtaggttgagggttcaagtcctttagccggcaccattaaatatgcgggtgtggcggaactggcagacgcactagacttaggatctagcgccttcggcgtgcaggttcgattcctgtcacccgcaccatattgaatgtgttgaagcgataaacatgtaaattgtttatcgcttttttgtatttctaataaaagacggagtggaatagttattgtgcctaagagactgctaaataagaactatcggatcaatgttgatggcattgcaaatattttgtataaaaatgtgtaaatccctatgtagaaaaaatataaatcgattatcattaattacgatatgatattttatatactataaagcatagataaaataaatttacattagcgcaaaagactgtaaaaaaaacagtacattttctgatcataatctttatcttttatatgcagaatttagttattaattatctataccatgaaaatcaaattgttaaaaaagctgctgatagaattgaaagtaaattgaatataattatagatgatatattttaaagaagaccatttactattatcattttatcaggaaactataatgaaaaataattttcttttagagattacagtttttctatggaaattcagagtgataaaaaatgagggtcatgtttggtttaatttgatagagacaaagtatatgttgtgatataataatgctactatgaataagcgaaactaccaaatattaaaatatttaaaagaaacagaggaatatgtaacttctgaaacattaagtgctatgaataatgttagtacaaaaaccatacttaaagatataaaatctttgaattgtgatatgaaagcaacagataattatatagaagtcactccatctcgtggtattaagctggtaattaacgatattgaagaatttataaatttatgtaattcttttaatgatactaacgatttttcaatttatagtgtgacagagagagaggaatggattcaaaaatatctgattgagaataatggttgggtcaaggcagaagctctatgtgaaaagctttttatctctcagtcggtattatcacaaaatattaaatccgtacgaaaggcttttcaaaaatatgatttaatattattacaaaaacctcattatggaatgagggtagaaggcagggagtttaataaaagactctgcctcgcacagatttatattacacatattgatcaaagagaagggtttcctggaacacaatttaacaatgatgagctccagctgattttgaagattgaagatattgtagatagaatattaactagatatcaaatatcaatgtctgaagtttcagttcaaaattttataattgatatttatatctctttaaaaagaattaaaaaaggaatatttttaaaatcaactgataagatggttatcgatatagctcgctggactgatagtatagtggctgttgaattggcaaaattaattaatgatgaattgacaatagaaatgaaagatcaagaaatagtatcactttctatacatttagcagcaaaaagaattatttgtcattttgatgaaagtatccatcgcattatcgaagattttgatgttaataagttagtcaataatatgattaataatattgactgtaaatggggaatcgatttaactcaagatgaagaattaaaatcacaattagtattacatttaatccccttggaggttcgttcgcggtataatgtagtgcttcataatccgttaattgataaaattaaacagcaaaatatctttgcctatcaaatggcagtaacagcttgtgatcaattcagtgattatcatggcaaccgccttagtgaagatgagatgggttatattgcattacatatgaatctagctttattgcgtacgcaaataaaaaacaagaaaaatattttagttgtaagtggtctaggaagagggacagctcatacattggcttatcaaattaaagagatgtatggaaaatatattaatgaggttaagacagctgattatattgagttaaataattatgattttacaaatattaatttattaatatccagtattccactaagacgtgatttttctgtaccaagtattgaagtcaattatttttttagtgataatgataaaaagagaattgaaacaatactgtgtgatcaagaagtatttaagataagagattatatagataagcgaatggtattaacatcaatcaatgcggatactaaggaagaagctatatcatttataatcaatagcactaattatgataaaaatataattcaagaaataattgaaaatgataaggtagctaatcatgaattagataatatgatttctattttatctttaaatggaataagtgcaaataatcaaacagaagtaattattggtattttatcaaagccaattctatggaatgaaaagagggttcaattaataattgttcccttgataggagaaccgataaattcaaaaatattaaatttgtatcatgaattagcttatatgattaaaaatcctttatatgttaaaaggatcatcagaaagaaaacttatgaagaaattattgcgatttttgaagaaatcgaaacggttttagaacgataataactagctgtttttactaaactatctaataagaagatagggtaactgcggattaaatcggcagttatttttattttacaaagataaattagcacgatacaaattttatacttaatgagattccttataatttatatgtaatatttattttttgataacttccacaaataaatagaaattaaaagcatggagttccataataactcattttataattatagctaaggaatataagaaaatagtttactgcaggaatgaaaacttatattttttggaaaaggagagaggagataaaatgaagttatctgaaaaattacaaaatggtttattagcattctctgctaagattgaagcaaataaatatcttggctcaatcaaggatgcctttacgatgtatgtaccttttattattattggttcatttggaagtatgttaaatattttagtttcggggactagtggtttagcacaatggtttccatggttaataaagctatcaccagcttttacagcaatgaattttgttactatttcatgtatggcattacctattgcttttttaatcggtactaaattggcacaaagagaagggttgccaactttagaaagtggattgatagggttattagcatatttagcagtatgtcctaatgccattagtacggctgttgagggattgaaagatcctattataatcagtggtttgggttcaggagttattggggcccagggcttatttgtttctatgctcatatcaatcatggctatagaattattaaagggattatcaaaaatagatgccattaaaataaagatgcctgattcagtaccaacaggaatagcacgttcattcaatattttaattccaatttttattattattgcattgtttgctatttgtggatgtttattcgaatcgttcactggtaattacttaaatgtatggatttataacattattcaaattccattacaagcattagcaaatacaacgattggaatcgtggtattatctcttgtcaatcaactattttggtttcttggaattcatggaggaatggttatcgaagggattagaggtccattatcagctgctggattggcagataatattgctgcggtttcagcaggacatgttgcaacaaatattttaacaaggggattttggacaagttttgttgttgtaggcggtggtggaatcacactgtcattattaatagctatattattattttcaagacgtgaagatcataaagcaattgctaaattttcaattgttccaggtatttgtggtattaatgaaccggtagtttttggcttaccattagtattaaatccaatttttgctattccatttatttgtaactctgcgattgctgcgttaattgctatttttgcgactaatataggctttttgacatgtggcattgtggattgccctcctgggttaccgatttttattacagggtttataagctatggattacatggaattattatccaggcaatcattttagttgtaactttctttgtctgggttccgtttgtttcagtatcaaataaacaggcggcaattgaagatgcaacagaaaaatctgaaaaagataaaaatatgaatggagaatgattatgaaatttcctacaaattttttatggggtggcgcaactgctgcaaatcaatatgaggggggatggcaagaagggggaagaggtattgctgttcacgatatgttaactgatggaaatcaagaaaatcctagaagaatttattgtaaagctgataatggtaatattacaagtattcaggctggggaatgtattccatttggatttcacccatttattaaggaatcagaatattatccaagtcataatgctacagatttttatcattgttataaagaagatattaaattaatggcagaaatggggtttaaagtatatcgtttatctatttcatggacacgtatttttcctcatggtgatgacaaagaaccgaatgaagatggtctaagattttatgatgctgttattgatgaattgaaaaaatataacatcgagcctttagtgacaattcttcattttgatatgccattgaatttggctgaaaaatatggtggatggataaatcgtaaattaatagaattttatttgaattttgcttctacactgtttgaacgctggaaaacaaaagtcaaatattggattacagtaaatgagattaatgttttaggtggatattggacattaggtcttgcatcaaataataggaagactaaaagtaattctaatcagggggaaacacctgttgaggatgctggaatcaagctgcaggcaattcatcatttattagtggcaagtgctaaggcaaataaaatagctagaaaaataaatcctaattttatgctcgggacaatgtgtgctttatcaggaatatatcctatgacttgcaaaccagaagatgtatttggagcatatgaatttagaagaaaagcgttgatgttttcagacatcacgatgagaggatattatcctaattatgctcaaagtatttttgatgaatataagttcactttaaaaaaagagctgggtgatgatgaggtgctaaaagaaaatacatctgactatttagctttttcgtattatcgtacaacagcatttgattgtgatgcaagtaatacaacaacgacaggagggcagcaagcatcacccaatccttatttacaaaaaactgcgtggggatggcctattgatcccaaaggtcttaggtttgttttaaatgaattatatgaccgttatcaaaaaccactattcattgtcgaaaatggaatgggtaattatgatattgttgaagaagatggagcgattcatgatgattatcgtattgagtatttgcgtagtcatattgttgaattcaaaaaggcagtagagatagatcaaattcctttactcggatacacgacctgggggtgcattgatattgtatcggcgggtacaggagaaatggcaaaaagatatggttttgtttatgtggatttggacgataaaggtaatggtacttttaaaagaaagaaaaaagattcattttactggtatcaaaaagtgattgaatcaaatggcgaaattctaggctagattattttatttgtttaaaattatgttatttaaagggaatggtttctaaaatcacttcctttttagtgggatagtgaaacaatgtaccagaattatactatttaatgaaatattgtaccaaaattgtatagacagatttaaaatgataataaataatagtatattaaagatatactagtgggttgttactttaggtaggcaagaccaaaaaagtgtaatactttttagtcttgtctttttgattaaaatacctgttctaaaaggagggaataataaaagtagacaatatacattgagtaaacaacacacaaattagagaggtgaggaagatgaagaaacagttaaaaaaaataatgactattgtcttaactgctggaatggtaatttcattattaggaacaccatcttttgcagttgaacatgtagggacaagcgatgcggctaaagaaatgtataagaatacatatgctaatttaacgaatcgaattacgaatcggggttatgcaccgacttctttgacaggggcttatgagggaatgtttattcgtgatagttcgattcaagtaatggcacaaaatgcttatggtgattatcaaaaatcaagacaagtattaaattttttgttgagctatcaacaaggactaggggcagattatgctcagcatatcgttcctgattatgaagatgaagaatttgggaactcctatctatcccagggagaaacagcacagacacaaaatttatatacctcacagactttttctgatcatgcgttatttgggttaaaaggaccaaataacggtggtggagtagcatttcaaacagatagtgataaagtaacatcaatttctattttcactaattctactggaaatgatgttttaactggaagtttgcgaacaaatattacagatgcttcaacagagttgataagtaaagagattacagttactgctagtggctggcagacatttacatttgaccagccaattactgtaaaaaaaggagaaacttatcatttctttgtacaatctaataatggtattgctatgttcggaaaggctgatgggaaacctgcggataatgctattatgggttataattatgatgttccggttttaggcggctttgcagaaagcgcatatccggcatttaaattaaacggaaatgatgatgaaaaaacagataattcatttatgtcaaatacagatcattcgattgctttatttttaattaatgcaactactaataattctgcttttgcatttgtgccaaatagtgattctatctgttcgtttcgagtttatttaaccggaagtgctcctgttacttttaagttgacaactgaacctggaaatgaggcaaaaacaataaaaactatttcacaaacagtatcaagtaatggctggcaaacagttgattttggagaaaatattcctgtgacaccaggacaaaaatattatgttcatattacaacaaccagcggtcaagttattgcttgtggttcttcaatgtttgcgggttctgtagcatctatgaactgggaaaataatgtttggtcacaaactggttatgttattgcagcggaagtattttcagaagttaatattgctcaatcaccatatgctcaaaaaatttcattaaatggtgatgcaattcaagccgtttcttttactgctgatgctaacgtggcaggtggtaatttgattggtgaattaagagaaagtttaaatagtaaggctattgcttcaggggagatagcaattgaaaaagctggagtacaaaattatcaaattgattttggaaaagaagttaaagtcgctgccgataaagattattattttgttttatgggctgaaaataatgattatgtacaatggaattataaccctgctcttaaagcaagcgcctatagtttaaatggtgataattgggatagtcatgattttgattttgagttagatatcctaccattatattcgggtgattatcgagtaccgcttatgacaattggagataaaaatattgggattcaggaaattccatctttagatcaatatgtaacggctgtagatgtattgttaggtaaaaataatttagaagagggaattgctattgcaactttatataaaggatatggtgcagaagcaatcaaagtagatgacgctgcgattgatatttctaagctatcttcaagtgggcaaatggtacatttagaatttagtttatcgttggaacaagtcgataaaacgcaatcttattatttagaaattaaagctccacaaaatagtgataatacaattacttggtatggaagtaaaaatgtggataatttagcaacattatataacgggactgcagtagctggagaggcaggctatgttgcatataaatccaatcttcatactttatccaatcatgttcaaattgatgggaattatatgttgatccatgcgtgggctcaatttgttaatggatgtaaaaagacggtagaaaatcaagagtttatcaaaaaatcctatccaattattaaaagatttgcaaattattatattgatcaaggatacataagtgacgaatataaattaatgagaaatgacagttttgagcattcacgtgagggaagatattggaaatcttatgatttaattacaaatgtatttgcatcacaagctttgtatgaactaagtgctttagcaaaagaatttggcgatagtgattctgcaattaaatgggctgatacttccgcaactttaacaaagggaatcaatgaatatttaacaactgaagttgatggagttaaaatttatgctgaattatatgatattgataataacatgaagtttattaaaggaatgtcatgggtcaattgggctccaatggcagctcaatggtatgcaatggatgaaaaaatcatgcaaaatacttatgatatttatgcaaaatatgatagtcaagattatgatgattataagatgttagatgttgtctatgattttgatactcaacaaagtggaaatcatattattggtaaagggttagcatgggaaattatgtttaatcgcgtaaaagacgataatgaaaagttagattatttagctagttttattttagatcattccactcctggtggtgtttatcctgaaacatatcaaccaaatggaaatttttcagatgttggaaaccaagagcatgcttcttggcagcattatgcaatgagctgtgcttatccagaattaacaaaaacatattcacttcaaatattagaagaattaatcaatgaaattcaggtgttagatgcaaagctctatacactagactcttatgcgaaactcagtcgagcattagatgcagcaattagtggctataatgttgaaaatattactaaagaacaaggcgatgcattgtacgaggcacttttagcagcaaaaaatgaactaacttatttagatgctgattatcaggctgttgatgcggctattgtagctgctgaaaaattaaacaaggatgattataaagatttttccaaagtagaagcagcaataaatgctgtagttcgtggaaaaaatattacacagcaagctgaagttgatgctatggcaaaagcaattaatgatgcaattgatactcttgaaaagaaagagggcagtgttactccaattaactcgattaagccagttgacaaaaagccagtagtcccaaatacgggggatgagaatttaatgagtctctatatctctttaattgggatcatggcaggtctgtttgtaatcataaagaaaagaaagaatatttattaaaagaagaattcctaggaattcttcttttgcacctgtttaaaattatatgttacgattttattttgcaggtaaaaacttaatagtgatgaatccgacaaaaactaaaaacatgatagcaataaacaaaacagaataaatactttcattaaagaataattgacaaagataaactagaaatgagggaagaaagccaccaattccagcagctattcccatatatccgcccacagctgcattacccttttctttagcggtctgcgctgcaatcaagaagatatataaaataatggtattataggtaaagccgaagattcccgaagtaatatacatgctgatgtaacttttcccaaaaatgtaaattgctaaagataaagcgcaaagaaataaggaaatggggaggaaattattcttgaatttattatatatcttattaaataatagacccgaactgattgaacaaatagaattaatgttattagcatggactgttattacagctatgtctgcaaatgatttcgtagcaaacaaagttgacaaattaataccaatcgatgacatcagcatatttaagattagaaagaaaatactgatggtgagaagtttgatgtttttttcttttttgatagttgatttggatggtgcttttaaaggaatatcaggaatataaaaagatagaataagtgttattactaaaggtaaataaccaagaaacataaagtcagttgaaatcttgcttaaatagccaactaatgtttggaagaagattgcacctagactggaaatgatcgttgtataacctaaatacttgatttgacgattatcagtgtaatattctaaaatgatggatttatttaaagaaatggcaattccgattccaataccaaagagcagtcgtaaaaataatcttgaatagagctcgtcaataaagaatggaccagtcccaccaaataaaagagcagcgttcatcgcaatcaatatagttcgataagaaacttttgttccaacaaacttactacaaaaatatgaggtagggataacagctatagagggaatcgtgatgattaaagagacagtagacataggataagcagaatattcttgatataacaaattcattcctggaattattgagcctctaatcgatgaaactaatgccacagataatattgataacaagatcagtttgtttttcattatatgttgataccaccttttaattaacattagcaaatattaaattataaagcaataattgtgtgaaaaagttgtaatattaagataaaattaaatatttaaggttaattttgttgtattataaaaatataaagataatttggaggaaaaaaagatgaagaatgattgttttagttttattaaattttgtaatgaaagaatcgcaaatagtaatgattataatattgctagaacgattattaatcacattgaggatattaaaatattatcattagagaagattgcagaagaagctaatatttctcctgcttcagttagtcgtttcatcaataaagctggttttgaatcctttcaggcttttaaatatgaatttgagttgtttactagggatgttaaaatgcgccgaattatttctcatactcaaagatttatgcggacgacgattgaaaatatgagtgaatctttatatgttgatggtcttgctaacttaagacagactaaattaaatttagatattgataagttaaaagaaattgttaagttactcaaaacttcaaaaagtgttacatttattggtgatagtcatgaactggcggatttttatacgctgcagttagagatgttagtcaacgatattccggcatatttgattaatttttatgagtttgaaaagatgtatctaaaccagttagatcataatgatactattgtttttattggtgtatataaggaatggttttctgatgctcaaaaagagattttagattatgcaaaggaacgtaaaataaaaatcattgcctttgttcaagaagaagattatttaaaggagtatgctgatttattatatgtttatggaattcctgacagttataatgatggttattattctttgccatatttaaatcgattgttatgtgaaatgatttatttcaaattataaaacctgcttggaactaatcgatatcattgttcacaagttgatcaagaaactcatcataacgcttcatcacatcatatgtctgcgggtaaatatcaaattattgaaacgattatgtcttatacttcacaatattcttttgctgaacttaataagtttagtgttcaagaactgtataatattttagctatatttaatcaagaggaggttcctgaagggtgtcagtcagggtataatcaagatagtcatcatagaaaaaatcataatcagcctaaataaaaaatcataaactataatactgtttatgattttttacgagttgatttatcattgttgaaaaaattagcatatttataattataccagattttcgagtaattaaattttttgccgtttgaaaggaaaacgttatcatcgataattaaaccaaaggcatcaggttctaggtttaaaagctcttgatcttcttttgatagtggtttagcaaaaatgtatttttcagaaaagccgatcgtaagttttaaatcattaataataaaagaaaaaattgatgtttttgcaatgtcttcattaagataaggaatgatgtctttgttatagtaagtatattcaacagcaaaagggatatcatcaatatacattaatcgttttattgcataaactggagtaccaactttacattctaaatgttctgctagatcagtatcacagtcaattaatttaaaacttaaaatatcacgttctaatttttcaccgggatgttcagctgaaaaaccgattgtgttatttaatttgatagttcctttatttggttttcgaatgtaaaaaccactaccatgaatagcaaataacaatccatcattaaccagcaaattaatagcattgctgatggtgtttttactagcatcatattctttcatcagctgcccaccagtaggcagcttttttgtttcttcaaattcaccattttcaattcgtttctttaaatcaatggaaattgtttcgtactttctcataatatctcccatccttatttataaaaatatcatttaattattattttgtaaagtgtttggtaacaattttgcatatataggacaaaaaagaaaccccttacattttgtattgacactggtattaaaacgttgtgttctaaaagtagataacaataaaattgtttggtaacaatcgcaaaagatgtagaaaaggagtgtgaatattgataataaatgtgttagtagtttggggaaataaaggggataaacgaatgaaatagtgtttattttggaaaggaaactttattatgaaaaagagaggtaagattgtttcgttattagttatagtggcgatgttttttagttatattgttccaatcaaggctcaaggaaattggcaacagcatttagatcaaactatcttgaaagtgggttatacagaggtttataaagataataaaccggtagtaccaaatgctaatctgacaattacgataactggaacgggattgagtggtaaagaatataacacagtactgattgatgaagaagcaagagaagtagaagcaacaaagcaaaatggggtaatcaatggtgacactactcaattagtgctgcaagtaccaggaacattgtcagggggtcaatatcaagtaagaacaacgattgatagtgaaagtgttacaaatggtctaattttattaaataatgttaatttaagcagtaagatcagtaccaacgttactggatattcaggagtaataggcgatttaattgatggtattcagtgggcgatgtatacgcccgttacaaataagccaactagagaaaatccaggaatttttacatttgattatggagaggatttaatagatgtgtattctttagatctatattcaacatatggaaatgaccaaggccctaaagttgcagaaatattatattgggatgatagtagtcaaacttgggaaaatattttaaataatggcagtcgtgaatttgaatttaggtgggataagaatattgaatgtgagccatttcgaattcaatttgatcaagtttattcaactaataaaatcatgttaaaaacattagattcatatactagttgggaaaatacgaatgatattgttgaagtacaggtatggggttataaatctggagagttaccatctattcaaataagttcttcacaaggaaattatggtgtgaaaaatattgtaccaatggtaataaaaaataagaataaatctactacaataaatttagagttagtcgattttaaatctcatcaatcactagcaagaccagtcaaatatcaagttgagatgaaaaatggtaaattaaattatgaatttgtaattcctaagacagtaccagtgggtacatatagtattcatgttacttgtgagggattagatctttatagtgatgagtatcgtatttcgttagatcaagatataaatattgaaaactgttctaaatatttagatatttctttggttaatgatcaagcctataaaattacaagtataactgatggtgacataaaaagcggttggagtaataatgggaatacgtctttattgtttgaagttaagcctgaaaataataagtttgccaatattgcattaaagaaaatgagaatttatacgagtaataaaaacattgaaactgttaccttaaaaggtattgcgaatactaattattatcgtaatgttaatgtcaatgaaaatgggatgatcaatgatttagctggtgattttaaaccagactggaaaagtgataaaaatggggattattttgaagttgatcccggttatttatctttgggaaatatatttattttagaattacaaagtaatgaaaatattgtaatcaatgaaattgaaacagaaggtgtatatttaaaagataatcttttatcaaatgcccgagtttatcataatggtgaaaatattgatgcagctggaatggttgataataatgtaagtagttattataaaactacatattctgatagtgatgagtatatcttagatttttcaccacggacaattacaactaatgaacttgtttatacggcacattttcctaattcacaaggtattggtaatttgactgtggaaatttgggatggtaatggttggaaaaatgttgatacatttgattttaaacataaaaccgataatcaaattagagaatcacagcagcttatttttaatgaacttacaactagtaaaattcgcttgatcgtaaataaagctaatctagtttgggataattcctatttatttatagatttaaatgcaattggaacaataaataataatgctcagtactatgctgaaagtattgataccaatatagttgtaaatcaaggtgaaagcaaatttccaattcctcatttaaaaggctatgaggtatcgatcaatagttctgatcatgaggaaatcattgatttaaatggtaatattaatgcacctttgacagatacaaaagttaaaataacattaaaggttagtagtgaagatggtcaggatgttggtatcacagatgagtttgaagttgttgtaccaagaagagttttgcccggcaataaattgatttcaactattgttgataatgaaacgatttataataatccgtcaatgggatgggttcaatattatgaattccaagataccgatgttgataaatattgggctgaaatggatgaattatatgctcaaggtttaaagacaaatattttatatattcgtaatccttggagctggtatgaaccatcagaaggaaattatgcatggaatgatcctgatagcaggttgagtaaattaattagtggagcaagagcgcgaggaattcaattagcttttagggtattggtggattcaagtgatgcttttcagcaggcaacaccagaatatgtatttaaagcaggagcaagctggtataaaactgatcgaactgatgatacggcaccagaaatcgatgctaaagatccatatattaatgatcctgttttcttagaaaaattagataagtttattaaagcatttggtgcagagtttaataatgatttagatattgcttttattgatggtatgggctttggtaactggggtgaagcacatcacgttaaatttagtactgagtgggatgataatgtttatgatgcggttgaaaaagtgattaaaatatatgataaatatttcccggatgttttattgggagctcaagaaggacaaccagaaaattatgggactcaagaaaatgatgagatcattaatactgacaaaccttatactggagcatttgacaaagaatatgattttgttgttcgccgtgatacatttggctggatgacggatgcaattagaaatcaaacattagaatggtttaatcaaggaataccagtttttgcagaaaattgttatcattcatttaaagtacgagaatactggtataataatgctggttatccgactttggatggtattttacgtcaggtcgtagctgatgctttggcatgtcgagcaaatactctagatgctcgggttgtaatggactgtcagaaatggctagagaatgatcaacaaaacggttctggtttattgaataaatttggtttgaatggtggctatcgcctcgctttgactagtttagaagttcctgagcttttcacgaccggggaagaaataactattaaacaagcgtggcgtaatttagggctaggcatgttgccgaataaaaataaacattgggataataaatatcatgttgctttcgcattattggacccaaaaacaaatcaggttatttatcaatataatgaagatactgataaagtaaacccgggtgattggcttttcgaagatggaaataatcattatgagactacatttaaattgccaaatagtattaaatcaggtgaatacaaactagcaacagcaattgttaatgataaaaataataatcttccggaaattgctttagcccttaaagatgcggaagtgacagagcagggctggtatgttttagatagtattaatgtaaaaaatataaatgattcagatacaacatttggtatttttattgaagatactgtaaatggtaaagttatagctgataggtcaactgttaacgctggtgaaagcgttactttaaaagttgttcctgaccaaggctatgaacttgatcaattactaatcaatgaaaaggcagttgaaattaaggataactcatatatgattaaaaatgttacggctgatattcgtgtaagggcctcatttaaaaaagctggtgaagtaaccgtaaaacctgatgagtctaaggatagttcagtagtagcaacgggagatgaggttcaattatttggatatataggaatgtttatcggagcattagttttattagctgagttgaaaaggaaatttaaacatcagagctaaaatataaaagcaggtaatttacctgctttttccacatataattatatttactaaaataataatcttttattagtaaattaattgacatggtttacgtgattaactataattgttagtgcataggattgttactatttgattaggcaagacctggttgtttaaagcgtttataagcgtgatgaacaatcaggtcttttatatttatttgggaactttaactaatcaaaatagctattctatacgggaaaaggaggaagttatgaaaggaagatggaatcaaaaattatgtgctgtagcaactgtttcaatgttgttatcatcagcaccagttggggtattagcacaagaaaatgcaagaattactcagtcagaccccgaagaagtatatgttgatatcattggagatgggcaaagaaccacgctatttaatgaaaattggaagtttcatcgtggtgatataaatgatgctcaaaacaaagattacaatgattcaacttgggaaacggtgaatttaccacatgactatagtattgatcaagatttcacaacaagcggagaagcagagagtggttttttaccaggtggcgttggctggtatcgaaaaacttttgtagtacctaaaaaatatcaagaaaaacaattgatgattgagtttgatggcgcttatatgaatgctgaagtttatttaaatgggacaaaattaggtgagcatccatatggatatactgcttttgcatttgatttgactgagggcttaatctgcgatggtgagactgaaaatgttttagtagtaaaaactaataataaaattccaagtagtcgctggtactctggaagtgggatttatcgagatgtaaagttaacagttacagataaggttcatgttggctataatggaactaaaatcattgctaaagatttagaaaatactaaggacaataatgttaaagttgatgttacagcaacaatcgataatgatagcgatacaaataaaacgatcacagttaaaaatactttattggatgctcaaggaaatgccgcgggtagtaccgtcactaatgaagttgaattagcagctaaaagtacaaaagatgtaaaacaggaagtgtctgttattgctcctaaattgtggtccactgaggatacaaatttatatacaatgaaaactgaaatcgtggcggataataaagttttagatacttatgaaactgagtatggtttccgctattttgattttgataataatacaggtttttcattaaatggtgaaaaaataaaattaaaaggtgtttgtctgcaccatgatcagggtgcactaggagcagttgctaatcgtgatgcaattgaacggcaggtcaaaatattaaaagaaatgggatgtaatgcgattcgtgttacccataatcctgcggcatcagttttattagaagtatgtaatgaaaatggaatgttagttattaatgaagcttttgatggctggaccgaatataaaaatggaaatgttaatgactacacttcacattttaatgaagtaattagtaccgataatcaaattgttaatggaaaagctggaatgaagtggggcgaatttgatgttaaagcaatggttgatggtgctaaaaatgatccaagtgtaattatgtggtcattaggtaatgaaattgatgaaggagtatcaggaaatacctcacattatttaaatttagttgatgatttaattaaatgggttcaagaggttgatacaactcgtccagtcacaaatggtgataatcgcaaaaatactaatccaaatgcgatgctcagccaaattaatcaaaaaatatatgaagctggtggcgtggttggaatgaactatgcaaatggtgatcaaactatagctatgcacaatacttatagcgattggccactatacggttctgaaacggcaagtgctgtccatagtcgtggagtttataatactacgggtaaagatgataatactttacaaatgtcagaatatgataatgatgaggcaaaagttggctggggacattcagcaagtgatgcctggcaatttgttattaagaatgatttcaatgctggagagtttgtgtggactggttttgattatattggtgaaccaacgccatggaatggaactggagcaggaagtgcaagtggtcagggagctaaacctaaatcatcatattttggaattgttgatactgcgggatttgtaaaagatacttattatttatataaaagtatgtgggacgaagatacaactactttgcatttaatgtcaacatggaacaatgatgaaatagtcaaaaataataatggtaaggtcaaggtcgatgtatttactaatgctgcaaaagtggagttatatttaaatgggaataaagtgggggaagatacagcaacaacgcatactactgctttaggatataagtatcaaacattttcaaatggagaattttacccaagctttaatgtaacctgggcttcaggaacgttgagtgctaaagcatatgacaaaaaaggtaatttaattacagaaactgaaggaagaagcagtgtaacgactaataccaaagctgcaaaattagcgataagtgctgataaaaaggaaattttagctgatggcagtagtttatcttatcttactgtcgatgttaaagatatgaatggaaatattgtcgctggagctgataatcgtattaatttcaagattgaaggaaatggtaaaattgttggggttgataatggtaatgcagctgatactgatagttataagggaacttcacgaaaagccttttcaggaaaggcattagtgattgttcaatctactaaagatgagggatcatttacacttagtgccagcagtgatggtttaagtggttcaaatatttctgtcaagacggttaaaaatgctgttgagggtgatgcttatctgcaaagttacacaattgctaaaaatttatatgttaatgttggtgaagaacctgatctgcatgcaaaagttgtaggaacatacaataatggggagacaagagacttaacgattaaatggaatgaatatgataaagaatcattaaataaaattggtgagttcacaataacaggaaaacttcaggatagtgaagctgtagtaactgtaacggttcatgtaattggtaatgtcgtagccatggaaaactattcaacagtaactagtgcaggaattacaccggtattaccacaaacggttcgaggactttatgaaaatggaaattatagtgaggcttttccggttaaatggaatattcctgctgatgcttttaaaaatgaaggaatggtaacagtaaaaggtacagtcaatgttctaaatgaagtaaaagatgttacagcaactgttcgagtagcaccaaaattagctgattcacagaatattgcttcaaagaattatcaagatacaccattatttacaaatgggaaaatggtcaatggtgttccaagtgaaccaacagcaacgccaatcaatgattcattgagtgaattaaatgatgggattactaatgaaagtggacgcgaaagcgcacggtggacaaattggagtttaagaaatgaaaatcctccggtggatacttatgtacaattagaatggcaaaaagaatacttgatgcaaaatattaaactgtggcattttacggataatcaattcagtgttttaccaggtgataacaatgtccggtttgaatattatgatgttccaacaaattcatggcaagaaattgagtcttcgcacattacacaagtaccatatacatctggtgatactccatatggatttattcacccgattacaactaataaattacgcatatggatgaagtcaccgcaagttaataaatgtattggtttaacagaaatagaagtatatgattatattttaccagtaactgcaaattcatctgcaaatctagatgatttaaaattagatggggttaatattaaagaatttaatggttatcgagggtatgataagcttactaaaacatatactgttgatttgaaaacagctgataccccatcagttatagctcaaggtaataataatgaagcaattactgttttaccagtatataataatgaagtaaagatcattgttagagcggaagatggtaaaacgatagaaaattatactattaaatatattatctcggtaaacaaagagtttcttgaaaactatattgaaagcgatgaaataaagaaagtttttgaaacaagtgaagaatatacagtccaatcgtatcaagaatttaaggaagcatatgatcaagcaatagtgattttgaaagatgatcaggcaacacaaaaacaagttgatgatagttatgaaaaattacaaactatgtatcaagctttagttaaaaagactgaagaaaaagttgataagagtcagttagaagcacttttagctattgctgataagattactgaagatattttaagtaatcttgatgctgatttagttaaagagtttaagaccgctttacaagcagcacaagatatttatactggaaatgatgtaactcaagctcaggtaaatgctgctattacacggttaaatgtggcaattgaaaatttaaatattcgtgatttcaataagattaaattacaggagctagttgagcggactgaaaaattatctgctaaagattatacaagggcttcttgggaacgattagaaaaagctttatcagcagccaaaattgtcttagcagatgaaaaggcgacactggcagctgttgatgaagccaaaacggttttacaaaatgcactagaacaattagagaaagttgcgattagcgaagagtcttctcaaggagtaaaaactggtgatgcggctaattttgctggtatatttgcattaatggtttcaactgcgagtctggttttatggatgaaaagaagaaaagaaaataattaataataatagaaggatgttttaatatgacatccttttttggaaatttgacatttttatgattatcgtattcgttgtatattcttactaagattgtataatataagtatagaaaaaggaggcgtttaaaaatgagtataccaataattattgtacttatagtagtggcgttaattgtgatttactgcatagttgcatataacacattaactaaattaaagaaccgggttaaaactaactgggcacaaattgatgtggtattaaaaaggcgggctgatttgatcccgaaccttgttgaaacagtcaaggggtatgctagtcacgaaaaggaaacgttagaaaatgcaataaaagcaagaaatacttatgtgactgccaatagtcctcaagatcagcttgcagcttctggtgaattaaatcaggctttaagccgattaatgatgttaggtgaagcttatccggatttaaaagctaatactaattttatggaattacaaaaagaattgacagctacagaagataaaattacgtatgcacgacaattttataatgattcagtaaataaatataccaatcaaacagaagttttcccttcagtgcttattgcaaaaatatttggttttggaacttttgattattttgaggttcaagaaacagataaagaagtaccaaaggttaaattttaaaatgaaagttaaaaaattatttttagcactctcaatctttctggtttctttgatgccgttacctgttttggcatcagggaatgaccttcaagcggttaatatgaacatttatattaatcaagatggttcagcaaaagttgaggaaacttggaagatggatgcgattgaaggaacagaaaactacaaggcatttaataatctttatggggctatgatcagtgatttttctgttgtcgatgaaaaaggaacaaaatatcaatatgttgataattgggatattgatgctagtcgtcaagagaagaaaaataaatgtgggatcattgaaaagagtgatggttatgagttatgttatgggataggtgattatggtcaacacacatatacgatgacatatacgattactccatttgttaatcaatatagtgatgctcaggggtttaattggcaattacttaatcaggaaatggatcctaaaccagctgaatttgaagcaacgattagttctgattacaagttttatgatcaagatagtgatatttggggctttggctatgaaggacaagttatttttgatgatcatggagcgataattatatcgaatcgtgatttaaacaataatcgtcgaggcgatattaattatgttaatattttagttagagtacccgatggaacttttagcaatgcaataaccaaaaatgaatcatttgaagctgttttagaagatgcacgtgatggctcaagttatcaagaagattctagtgatggttcaatatttatgtttattggtattagtgttgcggtacttgctgggataattgcagtaattgttggagttgtatctaaagcaaacaaaaataaacaattatattttagtgacggtaacaatgaaattccgacaatggaacatgttaatccgttccgtgatattccttgtcataaagatatctactatttttattacgttgcaacaaaagcagggattatccagcaagatgatcgttcaggtatcttgtgtgctatgttgttaaaatggatcagagatggctatgtgaattttaccatggaaccgggcactggctggtttaaaaaagataaatatgaaattgatttcagtggtgagattccaacagaaaatattttagaagaaaagatgttaggttattttcgggaagcaagtggtgataatcaaatcttagagaataaagaatttgaacgttggtgtaaacggaattatgaagaaatcgaagattggtttaatgatttgattgaatttgaagaaaaagaattaaaagaaaaaggcttaatgaaaaagcaaacaacttataaaaagttcttaggaatagatattgcaaatgaaaaagtagtttatgaaccatcatttagagatgatatcatttatactaaaggattaaaacgctttttattagactttagtagtattgaagaaaaagaagtaattgaagtaaaactctgggaagaatatttaatgtttgcttcaattcttggtattgctgacgaggtagaaaaacaaattggtaaactctgcccagaatttaatcaatattcaaatattgattacacttatacgatgttagcaacgagaacatttatgtatggtggtgttcgtagtgcagctaatgcatatagtgcagctcatagttcatcgtatagcggtggcggtggttttagttcctttggcggaggcggaggtggtttctccggaggcggcggaggcggaagccgataaaataaagaaaacctggaagaatgaaatgaacctcctaagttgttgcttcaacttaggaggttcgcttcaaaactccaggttattttattgttgtgcttctaattcagcgattttatcagcaaattgaggtaagtgttttttatgagcaatcaacatttcatctaataatgttttagcaatttgaccacttggaactaatggattaattgtaaatgcatgtaatgctttaccataatcaccagtaacggcggcttcaattgtagtttcttccattgctttcataatttgaaccattccccgagctgcaggttttaatgttccccaagaaattggcattggtcctgctgctgtaatgatagcagatacttcagctacactatcatatggaagatcagttaatgcccctttgttttgtgttgatacgaccatagttgtacgtttatcattatagattgagttgattaattcacaagcagcatcactataataagtaccaccacgttttgtcaattgttctggtttataatctaaattaggatctttatataattcaaataattcagcttctgttctttttacaacttcagcacgagtaccattttctttgaagtcggcaatttcatcttcaagcatatcatcagtgatatagtagtaacggtgatacatacatggcagatatcctaaatcttggatttgttctgcaacaaatgaaatatttttaatatttgctactccggcatcagcggcacgtttagcggctttttcctcttcttcctttgcacgtgtagcattagccccaaattttcttaaaccatcgttttcaacatatagtttttgaattgctttatcagttaattcagttccatcaacatcccatactcgatgccagtgaaaatggtttaatccagcgaatttaaagaataattcttcttcgtttttatctaaagctttcccaaccattttacggcaagagataggtacattacataaaccaacaactttatcccatttaccatatttgataacagcttcagtaaccattccactaggattagtaaagtttactagccaggcatttggacatagtcttttcatatcttcaacgatttctaagataacaggaacagttctaaatgctttaaacattcctccggcaccatttgtttcttgcccaataatcccatgacttaagggaattctttcgtctttaattcttgcatccaataagccaactctaaattgagtagtaacgaaatcagcgtcttttaaagcttcttcacgatctaatgttaaatgaatcgtcataggaacacccgcagcttttaccattctttgtgccattgctccaacgatttctaatttttctttaccttcttcaatatcaactaaccacagttctttgataggtagttcatcatatcttttaataaatccttcaactaattctggagtatatgaactcccgccaccgatggtagcaatttttacaggtctttttgccatttgtaaatctcctttgttttttgttacaaggctattataacggcaaaagaaaagaaagtggtcttttttcaggtgatgaaaaccgctttcattttatgaaaataatataataagttatcgtgcttatggtaataattaatatattattttaataacaggttgtatggattgatagttccgggaattacttgtaaataatcattttttaataattcattgattacattgcataatatattaatatcggtttcttcaccagtacattcaagatagagactttgactgccacaagcatcacgtaatttgagaatgtagtcaaattggcgttcttttaataaattattgatgtcttggacttggaaaattgaaattgttttcatgtttttaactccttttgttaaaataatgttataatttcattatataaaagtcaaggaggatatataatggctgcaactgaaaaagaaaaagcaaccaagctggctcatgagttagtcgcatacatagagagtgaacaaagtgatttgaaggctagtgataatgaatttgatgctttatggcaaagcatttatgatgtttgtatgctagttcattttaacattttagatgaactcttgagtgaagaggaatatttagaaggagttacttggctaaaagactatcaacatctcactaaagattaccaagataaagaattggaattatgaaaggataaagaataatgaaaaattatttaattgttaccgatacaacaagtgcgatgaacggggttcaagcgaaagaatctggaattgagttagtctcactaagtgtactgattgacgggatcgagtacaaagaccaaattgatatttcaacggaagaattatataaaaaactggaagctggatgtatccctacgacatcacagccaaatactggatatttacatgaattaatggcgaattggaaagctaaaaattatgaagctattatcattatcacctgcagtagtgatttaagtggaacttggagtggatttaatcttgtgaaaaatcagttagaaatgaataatatgtatatttatgatagccgccaagttggtgcacctgtcatggatatggcattagcggctaaacagatggctgataatgatcatgatgtaaatgaaatttttgaaatgttagaaatgaaaactaaaaatagtttttcttttttagccccatttgattttaagcaattggcgcgctcgggacggttatcgccggtagctgctaaaatggcatcaatcttgaaagtaaaagctttactttatttgaaggaagatggtagttgtgtcgataaatatgcgatgagtaggacagaatcaaaaattgttaaaactgtaattgacaaatttaaaaatgctggtgttaatgctaaggattatacattatacatctctcatgctgataatgaagaatcagcgctgaaagcaaaacgattattacaagatatttttgataatattgaggttatcgtaaacaagttaccagctgtattgacttgtcatggcgggatgaaatgtatatctgtgcattatatacataagatgtaataggtgagaaaatgaaagttgttgatatgcattgtgataccatcttgcggctttatgatgaaggtggctgtttatcaaaaaatgattttaatattgatttaaagaaaatggttaaaggtgattatttgttgcaaaactttgcgatgtttgtaaacttaagtgatcatcttgatccactaacaaaggcacagcgattaattgatctatattatacagaactagaaaaaagtcctgagctgattaaaccagtatatagttatgaagatattcttaataatcaaaaaaatggtctaatgtcagcgatgcttacattggaagaaggggcagtcgtaaataatgatcttgcaatcttacgtaattattatcgtctaggcgttaggatgattactttaacttggaatcatcctaacggaataggttatcctaatttgattagtactaaggaatttaaagatttatatcatttaaatacagaagatggattaactgattttgggattgcttatgtcaaggaaatggagcggttgggaatcattatcgatgtttcacatttgagtgatgcgggattttatgatgtattaaaatatacgacaaaaccgtttgttgcatcacatagtaatgctcgtagcgtttgcggagttgctcgaaatatgtctgatgatatgatcaaacagttagcgaaacgtaatggcgtcatgggaattaatttttgcggagatttcttaaaaccatcgagtcatggcgggatgcgttcatgtattgaagatatggttaaacatattttatatattaaggaactggtggggatagattatgttggcttaggtagtgattttgatggtattgatcaaaaccttgaattagctgatgcttcgatgatgccccaattagctgctgcactgcaggaagctggctttagtgaaaatgaaattgagaaagttttttataagaacgttttacgtgtttatagtcaaattttatagaaacagaaaaacgacaagtggggaaatcacttgtcgcttttattattagttatcagggaaaggatactaataatacatgatatcagggaaggatatctttatatattgtttgtagtcattatattgaagggaaaatcgaatatttcttttgactacattgttagtatataactaaacaatggtgaaaatgtatatagaatatcttaaaatatgtgataattattcgttcggatagatatcgagctattttaaaatggcgaaatatagtgtataatacacataagtggaggaatgaggatgaaaagcttattttatcgtttaattatctttttagatacagctagtgaagctgatacaaattataatattgcctggtatatggctcataatttttcaaaagtggccaaaatgggaattagtcagcttgctaaagaatgttatgtatccccggcaacgatttcacgtttttgtcgtgctttaggatatgaaaattatgctcatttaaaacaagaatgttcttcatttgcttcagatagcaaaaagtttaataatttaattaatgttcctttggacatgatgaaagataaacctcaagaatgtactaaatattatagtgatcaagtatgtgatgctatttcaaaattgtcacagcggttagactggaatgtgattgataaagttctacaggctattcatgatagtgattcagtagctttttttggaactcagttttctcattctgcagcgttgcattttcaaactgatttactaatgctggaaaagtttacaatggcatatatggaaacagaacgtcagattgattgtgcgcgtttgatggatgaaaatagtgttgcaattattgtgacagtaaatggattttatgcacggagtaattcgaaagttttacagtatttaaagaaatcaaaatgtaaggttgttttaatgacaaataatccagggatagatattggaataaacgttaattatacgattgtattaggtgatagcgaacagcgaaagattggtaaacatacgttattaacagcagttgaattgatgtcactgcgatattattctttatattatccaggaattcaggaaaaaattatctaaaaaggttttaacctttttttatggaaggaaaaagttatgcgtgagattaaatgtgaagatattacaaaaacagtaaaacaactatgtatggaagcagcttgtaatttacccagtgatgtgtttaaggcacttaaagataagatagatacagaaccatatcccttagctaaaaagactttggaagtattgattgataatgctgatttagctaaagataatatgatgccgatttgtcaagatactggtatggcttttgtgtatattacaattggacaagaagttcatgtggatggtgatttaaaagctgctattaatgaaggagtgcgtcaagggtacgaggaaggttatcttcgtaaatcagtagttgatgatccattatttgaacggatcaatactaaagacaataccccagcaattatttattttgatcttgtttgtggtgatgaatttaaaattgttgtagctccaaaaggatttgggtctgaaaacatgtcacaaattaaaatgttaaaaccaagtgatggattgcagggagttaaagattttgtaatgaaagtggttaatgacgctggacctaatgcttgcccgccgatggtgattggtgtagggatcggagggtcatttgacaaagttacgatgttgtcaaaacaagcaatgatgcgtgaaattggaacccatcacgaagatagccgatatgctgctttagaaactgaattattagagatgatcaatgctacaggaattggaccagctggttatggtggaaaaactacggctctatcattgaatattgagactcatcctactcatattgctggaatgcctgttgcagtaagtatttgctgccatgtagcgcgtcataaggaggcttcattatgattaaattgacaacaccgcttaccgttgaaaaaataaaacaattacatgctggtgatgaagtgttactaagcggaactatctatacgggtcgtgatgcggctcataaacgtttgatggctttgattgaagaaggaaaggaattaccttttcatttagaggatcaagtaattttttatgtgggaccaacgccaagtaaacctggtaaagtatttgggagtggaggacctacaacgtctgggagaatggatgcttttgcaccaacaatgatcaagttaggattacgttcgatgattggtaagggatatcgtcagcaggcagttaaagatgcaatcattaaatatcatggagtgtattttggtgctatcggtggagccggagcgatgatgtctaattgcattaaagaatgtacagtaattgcttttgatgatcttggacctgaagcgattcgacgtttagaagttgaggatatgccattagtagtagtgattgatagtaatggtaacgatcaatatgaattagggcgtaacgattatttaagtacatgtaaataaagagaaagtattaaagaggtaatataataatgtttaaaaagaaaagagattatggatattacagcagttatggaacaagtagtcgaagtcgccttaaggttggacgcgttgctcttgttggggctgttggggttgtcttagttattggaattgttgttgtgttaaatttgacacggattaaattattaatcaagggctattcattttcacaagcaagtgaaattttgtcattaacaaaagaacaagaaaatgaaattttatcccatgataaacttgatcatattactaattggatagcaaattctaaaaaagtttctttatatgatgaatacgaaaaatatctaggcatgaataaaaagatggaatatgctgatgttgttacatatattaatggattatttaaagaagaagtacctaaactaaaaagtatggggtatagtgagaaagttatttggaatttgattagtgataaagtatcaaaagaagatttacaatatttgatcgatcataattatactgccaaggatttagagccttatcgcaaagtaaaaggttatcaaattcaaaatcttgaagcgtatatcaacgcttataataattacaaagactataattatgcagtatgtattactaactatccatttttgatttcatctaatggtgagcctaaagaaagctatacaattactaatcctgatgatttattagttttagtaaaaaaaggtttctatttaccagaaagctatgaacctaaattagtagatccggaaattccagtagctccagattgtcaaaatccgaaaatgactaaagaaacatcagatgctttaactaaaatgtatgaagcagctaaaaaagaaggattagaattagttgttaatagtgcgtatcgttcatatcagacacaagttgatacaatggctgattttgaaagacgttttggcgggcagtatgcaaatgaatatgtcgctcagcctggagcaagtgaacatcaaactggtttaggaattgatttaactagtcaaagtgttgtagaaggtaaaaaaatcacttttggtgatactgatgaatataaatgggtaattaaaaattgtgctaaatatggctttattatccgttttgaaaatggtactgacggaataacgggaattgctcatgagccttggcatttacgttatgttggtaaagatgtagcaaaaaaaatcgttgaaaaggaatggacttttgaagaatattgtttatataacaatgtaatgccaaaagttacgaaaaaataatctaggggttacctctagattattttaatgaggtaaagaaatgaaaacattaattactactttaaattcaaaatatatacataagtctttatcgttaagattgctttatgtagctactaaagaatatcatgaggtggattttaaagaatatacgatcaaagaggatcttgatacaattgcaaatgatattattgaacaaaaagtacaggttgtggcttttagtgtctatatttggaatgttgatttaataaaaatattgatagataaattaaaaaaaatggacccacaattagttattgtaattggaggaccggaagtaagttatgaaattgattattttctagataactttaaaattgactatttaattagtggtgaaggtgaggtggcttttaaagaactgttagattgtttagaaacacagcagccgattaatattcaaggaattagcagaaaagataagcgagattatcaacaaactaagccggttgatctacaatatcttgaaacacttgaatcaccttatttattaaaacgtgatcttgctgatatggataagcggattctttattttgaaacaagtcgcggctgtccatatcaatgccagtactgtttatcttcattagaaaaaggattacgcttctttagtttagattatttaaaagcgcaattatcattattgcttgatagtggagttaagacaattaagctgctagatcggagctttaatgctaaaacagctcatgctttggcgattttagaatttatttttaagcattatcgaccaggaattcaatttcaattcgaaattaatggtgatgtactagatcagcgaattattgattatattaatgattatgctccaagaggattattacgatttgaaataggaattcagtcaacatatgagccgacaaatgaaatcgttaaaagatatcaaaattttgaacggttaagtgaggtaattaaacagttacagcaaaatcataaaattgattttcatttagatttgattgcaggtttgcctttagaaaacctagagagatttgcccgatcatttgatgatgtttttgctttttatccaaaggaactgcaattaggttttttaaagttattgagaggaacaagtcttcgaaaagaggcagaaaaatatgggtatgtatatgatgaaaatccaccctatgaattgctttatagtaatgatttaagccctgaagatattgggaaaattcatttggcagaagaaatgttagagaaattctggaatagtggcaagatgccaataacaatgaatacagtgataagaacagtcgcttcacctttttattttttcttagacctgggcaattattatttgaaacaacaatttaaaatgtttaaatttcaaaatgatgaattatttagttatttagacgaatatttaaatcggcagtatcaggatttattgattgaagactatttacggttatcaaaaataaaacctaaacgctggtggaaggcccgtttagataaaagcgaagcacgtgaaacaatgcattatttgatagaaaaatatgacttagaccaagaagaagtctttagatatggggtggttgaaaaggtaactgatggctacttattagcgatttatcaaaattatcaggttagtgtgaaaaagtattcttgataatgataaacggttatattacgttagataacgttttcctgtaatgggagagcgttttattttatgattataaaaagggctgggtaaaggagtatataacatgaattaaaaatacaaataagatatacttaatagtgcatggagggatatagaatgatagaaaatattcgtaagagagatgggcgcctagtcgcatttgagttagataagattgcaggagctatatacaaagcatttgaagcaagtggtggtaaatatgaattaaaaaatgccatgaatattgctaaaacagttgaaacaaagctagaaaaaaagaagagtgaattaccaacggtagaattagttcaagatacggttgaagaagtattgattgaacaaggatatgtacgagtggctaaagcctatattttatatcgcgctaatcgtacgcgtgaaagggatatgaagtcacggctaatgaagacttttgaagagattacttttgctgatagtaaagatagtgatctaaaaagagaaaatgctaacgtgaatgcagatgctccgatggggacaatgctgaaatatggagctgaagcagcaaaacagtttaatgagatgtttgtattaaatcctaaacatgcacgtgctcatattaatggggatatacatattcatgatatggattttttaactttaacaacaacttgttgtcaaattgatttaattaaattatttgcaggaggattttcaactggccatggagttttaagagagccaaatagcattagtatctatgctgctctagcttgcattgctatccagtcaaaccaaaatgatcaacatggaggtcaggcaattcctaattttgattatagtatggcaccaggtgttgcaaaatcatacttaaagcatttttatcataatttagctaaagcaattactttattagtaaaattagatggtgaagatattgcgactaaagtaaagggagaaatgcgtttaaaacctactttagataaaaatgaggcatttgaagaacaattaaaagaaacactgaaagctaataaagtagataaatttgtagatgaaatcgttgaatttgcaattacaagcgcttatgaagaaactgatcgagagacatatcaagcgatggaggcgtttattcacaatcttaatactatgcattcaagagctggagcacaagtaccgtttagttcaatcaattatggtatggatacttcaagtgaagggcgcatggtaatgcgtaatatattattagcaacagaagctgggctaggtcatggtgaaacaccaatttttccaattcaaatatttagagtaaaagaaggaatcaactataatgaaggtgagcctaattacgatctttttaaattagcttgtcgtacctctgcaaaacgtttattccctaatttttcatttgttgatgctcctttcaataaacaatattataaaggaacgccagaaactgaaattgcttatatgggatgtcgaacacgagttatgggaaatgtttatgctccggacaaagaaattagttttgggcgtggaaatttaagttttacttctatcaatttaccaagattggcaattcgttctaaaggagatgtaaatgagttttttgataagcttgatggaatgttagatttatgtattgagcaattgttagaacgttttgaaattcaatgtcgtcgtaaggctaaaaactatccttttttaatggagcagggagtttggcttgatagtgatgaattaaaacctgatgatgaagttcgtgaggttttaaaacatggaactttaacagtcggatttatcggattagcggaaacattaaaagctttgattggggtacatcatggtgaaagtgaaaaagctcagatcttaggattacaaattgttgctcatatgcgcaaggcaatggataaagcaactgaaaaatataatttgaattttagtttgattgctactccggcagaaggactttcaggtcgttttgttaaaatggataaaaaactttttggagaattagacgggattactgatcgtgaatattatactaatagtttccatattcctgtatattatccaattagtgcttttaagaaaataaaattagaaggaccatatcatgaattaactaatggtggtcatattagttatgtcgagatggatggggatccgactaaaaatattgctgcattcgaaaaaattgttagagcaatgcatgataatggaattggttatggagcaatcaatcatccagttgatcgtgatccagtatgtggttataatggaattattgatgatgtttgcccgttatgtggaagaagcgaggaagaacatcatggttttgaacgaatccggcgaatcactggttatttagtaggaacattagatcgttttaatgatgggaaaaaggctgaagaaagtgatcgtgtaaaacacgaaaccaaggaatgaataattaatggaaattagattatttggtacggttaatgattctattgttgatgggccgggcttaagatatgcgatttttacccaaggttgttttcataattgtttaggctgccacaatcctaaaagccatgatattaatggcgggtatattagagatactagtgaaataattaatgaaattgatgaaaatcctttattagatggaatcacgttatcaggtggtgaaccaatgttacaaatcgagcctttaaaagaactttgtaaagctgctcgacttagaaaactaaatattgttatttatagtggttttacattcgaacaaattatggatgatcctaataaaaaatcattattggaactttgcgatatgctaatcgatggcaaatttgaattagataaaaaaagtttagctttactttatcgtggttcatctaatcaaagattgattaatattcaacaatctctaagccaaagagaggtagttgaatatttggctgatgagaataatgaaattaagatttaaggaagcacagcttccttttttgttttaaagattggtgattagtttataaagcaaataaaaaggcactatgcaagtgtgcctttagactatacttatttaattaataagttagcttgtaaccaagctctctcttcatttgttaaaaatggtgcaacatgatcaaatactaattgttgataatcattgatttgtttgatttcatgattagataataattcaagatctaaaccatctaaatcaaatggaaccattgtaattggttcaaattttaagaactgaccatattcattagtttcgacttcaacacataacaattcattttcatgacgaacaccatgactattttcgatataaataccaggttcatctgttgtgatcattcctggttcaaaagcacacattttagcaaatcctggacgatcatggggtctgaatccatttggtccttcatggacgtttaagaagtgaccaactccatgtcctgttccgcagcgataatcaagattgtattcataaactataccacgtgctaataaatctaggtttggaccagttgttcccgctaagaaatgagctgcttgtagtctaaacattgcttttaaagccacggtaaaatcacgtctttcaatatcactgataggacctaaaacaaaggttcttgttgtatcgatcgttccatctaaatattgaccaccagaatcgattaatagcattccctcgttagttacttttgcacaatttccaggttctgctttgtagtgcatcaaagcagcgttagctttgtatccgcaaatagtatcaaaacttagatcaaaaaattcattttgttcttttctaaatgctgctaatttatcagagatggtaacttcatctaattcgatttttccaacgttgttttttaaccaatacatgaatttagtcatagcgacaccatccttgatatgggcatttttggttgctttgatttcagtttcattttttatcgctttaaaatgttgagttggattaggtgctgtttttatttcacaatttagattattgaagatttgataattaacaatttgatcatctaataagacttttccagttagttttttaacatcttcataaatatcattataagctctgatgataatactatccctttttaaaatagcttcagttttaacatcaacgacgttatcttgaacatatagaatagcattatcttgattaatcaaagcataagatagtacgacgggattacaatctacatcgttaccacgaatgttaaataaccagacaatatcatctaagctagtaataatatggtgttggcaatctcccatggcactgcgcaaacgtgcaagttttgaagcacgtgattcaccgcaatattcttcatcataaataaaagctggctcatgagagatgctagggcgttcactccaaacttcatcaactaagtcaacatctgtaattagtttattacttaaacgagcaacttcttgatatgacattactcgtccatcaaaaccaacagtcttatcagtgttttgatcaagatattctttgattgttggaaccccaggcatagccattttcattaaaataatgccacttccagctaattgttgttctgcttggataaaataacgcccgtcagtccataaacgtgcttcatctagactgattactaatgttccagcagaaccggtaaatcctgataagaatttacgtcctctaaaatattcaccaacatattcactttgatgaaaatcactagttggaatgatataaatatcaattccattttctttcattaatgtttgcatttttgcaatattttcttttatcatattcataacctcactaacaatactttatcacaactgattagctccctcaatgaatataaaaaaaataaaaaaaaaacttacacaaataaattttttatgctaggatagcattgcattaaaagaatattactaaataatggtagtgatgattaagtcagctgacaaagattgtagcgaaagttatggttttgttaactggcttttttatgttaaaaggaggaaaaattaatgccaacaaatagaaaagaaagtttagtttttacaatgtttatgtgtgcctttatggttttttggatgagtgtctataatgtcagtttacacttcggcttttcaagcgaagcaatcaaagaagcatggttgggattcccattagcctatttatttgcaattttatgtgattgggtaatagtatctaagtttgctaaaagtttagcttttaaagttgtaaatcctaaaaataaaccacttattaagattattatgatctcgttttttatggtctgtggcatggttattttaatgtctttatacggtgcagttgaacaggctggaatcagtgaacagactttaatggtgtggttgacaaatattccaaaaaattttattgcagctttaccactacaactgttaattgcaggaccttttattcgaagcgttttcaaaatcttgtttactagacaaatcgcatagattgtctagtgattttatcaaacttagcgctataattatcatgttaaaaaagcatgataattatttttcacgaaaaaaatataagtctttaaaaagtttgttaaatcgttgtaaacccttgtcagactagggatacagcgaaaatgactatttttttcaattgatagattattatcgttgcatttttaaaatataggagtatacttatctcaggcaaagggggcttatactatggatgatgtaattcaaaggttagtagaaatagaccgtaaatgtgtcgaacgtgttgaagctgcaaaagctaagaaattagatgcgcaaaccaacatgaatgaaaaaagaaaagagatatatgatggttttgtcaccgaacaaaacaaaaagattgaggcgcataaagctgaattaatgaataaaaacaaagaagaagcaaagcagcttgatcaagattataatgatactgtagctaatttagagaatctttataatcaaaataaggacaaatggatcaatcagattgtcgaaagatgtttaaagtaagaaggtgaaggtatggctttatcgtcaaatgcactatgtgctaaggctaaagcgatgtatggataccgcattggtgaggaaggttatagtgatctatgccggaaacagtcacttagtgagatggtaacatacttaaaatcgcaaacaaagtatagtggtgttttagaagatattaatgtccgtaacgttcaccgtcgccaagtagaggctgctttaaataaagaatactttgaacgttgtgcgagattaatgaagtatgcaccaaaaaagaatcaagatttctatagccaagaggtcattggaattgaggttcaattgattgttgataaggttgtcagtattaaagaaaaagatcaagcgagtttttctttggagatacctgattatttagcaagcaaaatgagtttcaatatttatggattgatcaatgttgataactataaggatctagtaacatatttaagagatactaggtattataaaatattagctgattttgattttacagcaccgattgatattaatgctttagaacgtcagatgaaatcactattttatagtacttatgtggctgccattaaaaagaattttaagggtaaagaacaaaaagaattattagatattttatcgacatcgattgagttgatcaatattacgaagatctatcgattcaaaaaatattttaaagaatcgaatgaaacaattaaaaattctttatatttagagcattgtcgaatgtcttcatcaatgttggatacattaattgaagctcgtagtgcaaaagaattgatggaattattagctaattctaaatataagctgtatttaggtgataaagactatgcttatatcgaatattatgttgaagaagttagatataatatcgctaaaagatatatgcgtttttctagtaacgcaccgttagtatatttaacatattcaatcttacaaaaggtagaggttgataatctaaaacatattattgagggaattagatatggacgagatgcatctagtattgaagagatgctgatctttgcataggagggattaatgaatggctattataaaaacacatttctttaatatttcctttgaacataaagatttgatgaaaatgctaattaagatgaccgagtatcaagatgaaatgtttcctcaagattctaaaaaaatagcaaataatgttaaaggggtatcagttatggatgaagctaatccgtataatgaaccactagataacatttatcacatcttaaatcgtttaaatcttgaaagtaatgttcaagataatgaatttaaagaaatcaacttgcataatgcaaataaattaatagatgatattaatgataaaattgataatattgtcaaaattaaagaagatattacaaaagaaaaagaagaaaatgatgaagcaatcattttgttgaaaaatctagaagaatcaaaaataagtgttgatgatgttaagaatactaaatatattacctgtcgatttggaaagattcctgtgaatgaatttacaaaaattcaatattatcgtgattatgaatttatttttagggaattgaatcgttctaaacaatatgtttggatcgtttatgctggacttacaagcagtatttctgaaattgataatgcattttcatcaatgtcatttgagccaattagcttaccggagtttgctcatggtaaagttcatgaagcaattgacgaattaactgaagagtcaacagctatggaacaatatattgctaaaatggattctaaactagaggatataaaaaaggaatataaagaagaggttttagaaacatttacaagattatataacttaaaaagactatttgataaatgtcgttatgttgtggacttttcacaaaaagcttcgatctacactttcagtagttttgatttaaaagaagctgaagcaaaatttgatgatattgatagtgtaaaagttatggaactaccagttaatatctatgaaaatagaaatattgtggcaccagtattagtaagaaataatagtttaatgcaaccgtttgaaaatgtcttgagtgtaacacttggtgacacttttgatccaacgacgatagttgctttattaacgatgcttatcggtgctgtttgtgttggtgatattggtgttggagctttattaattgtattagggttcttatttacaattaaaaaacctaataattttggtggcatgttaaaacgtttaggagctgctgttttaattggtggtttattttatggaacggcgttttatcgaattgaattgtaccagccgttagcaagtttaccattacatgttattcatactttcttatttggattcagtctttggatcattgcgatggtgattttaattattgtgaaaaaagttacgcgaaaatcaatcaagatatagaggagggatataatggcgatttcaagattaaacttagttagtattaattttgataagtatcgttacaatgaagttttattaaagctttttagccatgatgactttcatcctgagttggcctctaagtttattgatagtgtaacgggactaagtgtttacaatcaagataatctttatgaagaaatcttggtgcgattgaatgatgcatcaaataagtatcattttaagctagaagaagtgccagttgaaactaatcaaatcaatgtgctgcgggtaaaagaatatttagatgatctactgcttgatgttgagcgaattgatgctgtaaaagtacaattagatcggatgattattgaaaatcaggaagcaatcattcagttgcaacatgttgctgatattgatgttgattttgatgatttgtttagctgtaaatatcttcaggttagatttggaaaaattccagtaaataatgtttctaaattagattattatgaatcattaccatttgtctttaaagcatttcacaatgataatcaatatacttggtgtatgtatattacaacgcctggtgatgcaccagaagttgataatattttctcatcattgtattttgaacggattcatattccggcctttgttcacggttcaccagaacttgctattggtgagattcaagaagaagctgatgttgctaaagaacaaagtgaaaaattaaaagagcgaattgataaaatgtttgctaatgaccgtgataagttgaatgaaatctatacgattgcaaaacatttaaatgatgtctttatcatgcaaaaatatgttgttgtaatcggtgataaactttctgtcaatggttttgttccaacacgtagtgttaaaaaattcaaagaagattttgaaacattagagaaagtaacagttgatattaaaccagctaatagtgatgttcgtttatcgccaccaacattgcttaaaaataattggttttcacggccgtttagaatgttcgtcgaaatgtatggggtacctaaatataatgatgccgatccaactttattagtggcattatcatataccttgttattcggaattatgtttggtgacgtaggacaaggggttattttatcacttgttggatttgtggcttataaaaagtttggtttacaattaggtgcggttggagtccgtttaggaatttccagtatgctttttggggttgtctttggttcggtatttggaaatgaggaaattttgattccgttattcaatgcaatgtcgccagacaacacgatgacattattgatcgctgcgatttgtttaggaataattttaattattatttcgatggcgtttaatgttattttgagttttaaaaagaagaattttggagaagcagtgctaagtcaaaatggaatttgtggattagtcttttatatttctattttgggattagttataaatatgtttttaggattaggatttgttaatgttatttatgtagttggattgattgcattaccactatttctaattttcctaaaggaaccactaattagaaaatttgaagaacatgaagcaatgttcccaaatggttttggtgcgttctttgttgaaggattcttcgaattattcgaagtagtcttatctttcatcactaacacaatgtcatttttacgggttggaggatttgttttatcacatgccggaatgatgttggttgtatatacattggctgaaatggtcggtggcgttggtgagctagccgttataatttttggtaacatttttgtaatgtgcttagaaggattaattgtcggaattcaagttttacggttagagttctacgaaatgtttagtagatactacgaaggaaacggaatttcatttaaaactattaaagaggattaaaaatcgaggaggaagtcattatgacagttttagaatttattttaccagcattagtagttatcttattatcattaccattaattaaagtattcacaggaaaagtaagcgtaaaaagcgctaaaattagattagcaactcatgttgctggatttgctggagcagtatgtttagcattatatttggctgctgtaactaacggtgtatacgctgaagaaacagctgtaattactggaacaattgctcaaggtttaggtttcgtagctgctgctttagctactggtttatcagctttaggagctgggatcgctgttgctgctgctgctcctgcggctatcggagcattttctgaaaatgaaaagaactttggtaaatcattaattttcgtagccttaggtgaaggggttgctatttacgggttattaatttctatcttaattatcaacaaaatctaattgaaagaatgtgatcattatgcgattttattgtataagtgataacgtcgatacccaagtaggacttagattagtaggaattgaaggccaagtagttcataaaagaagagagtttcttgaattactagaaacaaaattaaaagatgattcgatcggaatcatcttgatcactactaacttaattgaacttgcgcctgatgttatctcagaaatcaagttaaaacaacaaaaaccattgcttgttgaaataccagaccgtcatggtgaatcaaaaattggtgaaacgattgacaaatatgtttcagaagcaattggtgtgaagttatagaaggggaatgctatggaaaagaaagaacaagtatttctttatatgaaagaagagattgaaagattagcaaatcttgaagaagaaaaaatcttagatgaagcaaagcgtcttgaagaagaagcatacaaccaaattaaagctgaagctaagaaagatgccgaagcattacttgctaaagagttagtagaaatttcttcaaatgctagtgttgaagcttcttcatcacaagaagaaaagactaagaagttagttgaaaaaagagatgaatatgtagctaatatctttagtgaagctaaagataaattagttgcttttgcaaatagcaaagattatcaggcgtatctagttaaacatatggaagaaattgggaaattatatccaatgagtgattcaactcttgaacttagagaagctgatatgaaatataaagatgaattgattaaagcttatggtacagctttagaagtagaagtaagtgataagattacgattggtggatttattgttaaaaataaagctactaatgtcgttgttgatgaatcattagactttgctttagaaaaccaaaaggattggttctataaaacatcaggattaatgattaaatagacagggggttaatatatgaacaataatgtaatttattctattaacggacccgttgtaaaagtaaaagatacagtgtctttttccatgttggaaatggtatatgtaggtaatgattcattaatgggtgaggtaatttcaatttctaaagaatttactaccatccaagtatatgaaactactactggtcttaagccaggtgaaccagttgtttcaactggttcgccaatctgtgcaacgttaggcccaggaattttaagaaatatctttgacgggattgaacgtccactaaaagcacttgaaaaagaatcaggagcatttatccaagccggaagcaatgttgattctttagatattgctaaaaagtgggatgttacaatgactgttaaagttggcgatgaagtcaaaggtggaactatttatgcaacaacacctgaaactgatttaatcgttcataaatgtatggttagtccattgattagtggtaaagtggttgaagtggttgaagatggtcaatatacaatcaatgatgtggtcatgaaaattgaagatgctcatggtaagatcattgaatgtacattatgccaaaaatggccaattaaacaatcacgcccagtcacaaaacgattaccaattggaacacctctagtaactggtcaacgggttatcgatacgctgttcccgattgctaaaggaggaacagctgctattccaggtggtttcggtacaggtaaaacaatgacccaacaccaaattgctaaatggtgcgatgcagacattatcgtttatgttgggtgcggtgaacgtggaaacgaaatgactcaagttcttgaagaatttagtgaattgatcgaccctaagagtggtaaaccacttactgaccgtacggttttaattgccaatacatcaaacatgccagttgcggcacgtgaagcaagtatttatactggagttactttagcagaatattatcgtgatatgggttatcatgttgctattatggctgattcaacatctcgttgggctgaagcacttcgtgaaatttctggtcgtctagaagaaatgcctgctgaagaagggttcccagcttatttaccatctcgtttatcacaattctatgaacgggctggatatatggaaacattaaatggacaagaaggttcagtatcaattatcggagcagtctcacctcaaggggcagacttctcagaaccagttactcaaaatactaaacgtttcgtacgttgtttctgggcattagacaaagctctagcttatgctcgtcactattttgcaattaactggacacaaagttatagtgattatgtctatgatcttgaaaagtggtatagtaaaaatgttgggcctaaatttgtaagtgatcgtcaagaaattgcttatatcttagcagaagaagcaaaattgaacgaaattgttcaattaatgggtcctgatgtattgccagaagatcaaaaattaattattgaggttgcaaaggtagttcgagttggatatttgcaacaaaatgcgttccataaagatgacacttatgtaccaatggaaaaacaattaaaaatgatggaagtaattttatatttaaataaacgttgtaaagaagcggtaaatcaaggtaaagtcgtaagacgtatcgtagatactggaatctttgatcaagttattaaaatgaaatatgatattccaaatgataatattgcaaaattagatacttattatcatgatattgatgaagcaatcaaatctgtagcgtaggaggaaaatgattatgtcattacaatatgtaggcttaaatgaaataaatgggccattagtcgttttagaccacgttaagggtgcttcatacgatgaaatggttgatattcaactaaaagatggaacaactcgagctggtcgaattgttcaaatcgaaggtgaaaaagttgttgttcaagtatttgagggaacaaatggcttgtcacttgaaaatacaaaaacaaggttattaggtaaaccgatggaattaccagtttctaaagaaattcttggaagaattttctctggtgctggtcgcccaattgatggtttaggtgaagtatatgctgaagctgaaatggatatcaatggattgccattaaaccctgtatcacgggtatatccacgtaactatattaatactggaatttcttcaattgactgtttaacgacattgattcgtggacagaagctaccaattttctcagtatctggtttaccacatgaccgtttagcagttcaaattgtaaaacaagcgaaaattgctgatgaggcgggtaaaggatttgctgttgtttttgcagctatgggggtaactaatgacgtagctgaatactttaaacgtagttttaaagaagctggggttatggaaagagtagtcatgttcttaaatctttcaaatgatccaattattgaacgtattttaacgccacgttgtgctttaacggctgctgaatacttagcatttaaacaaaatatgcatgttttagtaatttataccgatgttacttcttattgtgaagctttacgtgaattttcttcaagtaagggtgaaattcctggtcgtaaaggatatcctggatatctatattctgacttggcttcattatatgaaagagcaggaatcatcaaagatgctgaaggttcagtaacccaaattccaattctaacaatgcctaataatgatattactcatccagtacctgacttaacaggatatattactgaagggcaaatcactttagatgttgatttaaactcagctggagtttatcctccagtaggagtattaccttcattaagtcgtttaatgaaagatggaatcggtgaagggtttactcgtgcagatcatcaagatattgcaaaccaattatttgcatgctatgcccatgttcaagatgttcgttcattgacatcagttattggtgaagatgaattatcagatatggataaaaaatacattagctttggtcgtttatttgaagaatactttattaaccaaggttttgatactaaccgtagtattgaagaaacattagatttaggatgggatctagtttcagttcttcctcgtgaggccttagaccgtttagataatgctctgttagatcaatactataatcatgaaaaagcggttgaacgctttaacattaaagaaaagaagattattaaagaattacaagaagaaggtgaataatcatggccttgaaagtagttccaactaaaggtaatctaattgcaatgaaaaaatcattgcaattagcgaaccttggatataatctaatggatcaaaaacgtaacgttttaatcaaagaaatgatgactttattagatgatgtaaaacttattcgtgatcaaattacttcttcatatcaagaagcatatgattcacttcaagaggctaatatttcaatggggttaattacagatattgttaatagtacacctgaggattatgggatttcaattgcttatcgaagtgttatgggggttgagattcctaagattgcttatgataaacaacccttaaagatgacttatgatattgaacgttcaaattcaaaagtcgattatgcttataattgtttttacaacgtaaaacaattaacagttttattagcagaggtagaaaatagtgtttatcgtttagctaatacgattcgtaaaacccaaaaacgtgctaacgctttaagaaatatttcgattccgcgcttcgaatcaactattaaggttatttcagaagcgttggaagaaaaagaaagagaagaatttacacgtcaaaaagttattaaagaaatgaaaaaatagaagctatgcttctatttttaacatttaataaatttaatttgttcattttttaaagaatattcaagattagctggtagtttagaacgaatatgaattaatttattatcagcaatagtaccattccatgttgctacaacaattatttttttagctaattcttttaaaaatgttaacatatcgatatttgagtccttagcataaaggactcttttattatccaacaaaagaacttctttatcgtagttatcaataaagtcattcattacagtgatgatttcactacaatcatctttaaagatctgatcaagatttagaattggaataccggtttcattgctatagtcatgaataagttttgatttaccactcccaggaccaccgataattaaaattagtttattatcactattttgggcggtggcgatttctgctgttaacgggttcatgggtctgtcctcctttttatattctctttaatccaaaaaaccttgttaaaatcgacttattatctattttcattctatcatttatatttgtcatttcctagcaatatcataattttactagtatttcctaggaaatattgacgatttatagtcattaagtatttctaaagtttttctaaaaaggtgtactatctattgtgatacagttaatgcgatgatataatgaaactgtactatagggaatgatacagttttgttatgaaacatgatattaaaaggagatgcttagaatgaagaaaatgcttacttttttaatcgctacgattttgattttggctatgtcgttgatgccactacaggcaattaccggcataaatagcttagttagttatggtgaaggtaatgaaattgaaggtggctgtaatgggaaaaatgttgatttaggcgaaggactaagcggattgatggtatctaatcaatcagagttagtttttattggtaacgatgattttaaaatcaaagttggtaagccggttaaagaatttgaaataattgatgatgttgataatgatggtcttaaagatgttgctgtttatattgatagtgaagatgattatgatgattttaaaatcgttagttcaaaaacttcaaaagtattatatgctacaaaatattcttataacacgattaatgataataatgaggcagtgaataagaatgccacaattagacaaattctatttaatgataatattgtctatttaatttataattatcatttagtaggaattagtacaaaagattatcaggttgtatttgattatgaagcgaaagataatatttggaaaatggcattagttaataatcaggttatttttacgacacaattaggagaattgggaagtcttaataaaactaatggaaaattaaattatacagttgcattaacaacacctaaagaaattaaagatccacgatatgatactttggggaaagtcaatttaaatatttgggatattgtgtatattaaagataaattgtatgtaactacagaagatgccaaattatatcaaattgatcaaatgaatgggaaaattattaaaacagtaaatttagaagaggatattgatgagaaattaggaaatttattaaaaaacaataataaatggagcggtcaactagttcctacaggaatccataatattagttttatgagttatcgaatggatttattagataataatttaatgttgataagtgcttacttggggagtccacaaattgaattaaatgaaggagatagtgaaaaagagatacctcatttaatacttattgatcttgaaaagatggaggttaaactggatattcctgttgagcaatataatttagattatagtagagcggttaaaggtatttttgataatcagcctgctttggttgttccaacgtatgctagtactggaaagttaagacttgtcgcttattcattaaatgatggtacagtattaaaacaaactaatttgaatcttaatggtattaatagtaaaaatgtgaaaattcattttgctaatcaaggagaacgttatttattacaagttgacgggggtgtgtcactgcttgttgatcaagatttgaaaacaatagagtacttaggtagtgttaaagttgttaataaagttgttgatcttagtgatggtacaatcgtgtctgttttgaataatggtaaaataacgcaaattaaaaaaatgggtttaggtggccgtgatgataatttagttacgtttaacattccagatggttatcataataatggttttgaagcgattaattatgatgaaaaacataatcatcttttaagtttagtcagtgaactaaacgctaatggtgaggtaattgctagtcatatcgtaattatgaatttaaatgacggaaatacgctggcagataaaaaggtattattagaaaaaggctatgatgaaaataataagtattatgaacattatttaattggtgaaacaattagatattttacagatatgaataatgatggcaaatcagaaattattgttgatgagaatattcttgatggggcatcgttaacatttagaagtgtttataataaatcatttgaaggtgctactacgattattgacgtaggtgatgtgaataatgatggaataagtgatctagtcaatattggtgaaagtgaaatgcgattatattattcgttaaagaatggttatgatataacttatcaaaaaactaatattgctaaaagttatgataaaaaattgcaaaacaatattcatgttaaagtgctaggcgatcttgatcatgatggaatcaaagattttgtaatcaatgcttataatgataaaggctgtcaatgtttccaagtcattaaagggaaagacttatcggtacgatattcattattaaaagatggtgttatctatgaaaatgaagaagatagttttagtgtgacaggaattgattatgacaatgatggagttgatgatcttgtttatggtatttatgatgaaatgaggactgttcttagtggagcaactggtgaaaagttatttgaatacttaattactgattatcataatgattgggataattctatgggtgatccggttcctttggaaaatatagttagttttaatttaattgaaaatggaaatagtgtagttaaaatcaatgatcttaatgatgacgggattcaagagttagcgtatttagttagggattatgataattctgactatggtacaaagaatattctaaagattttaaatggaagtaattatgaggagttaaaaagtaagatccttggtaaaggaaactatgattcgagtcaaattactacagtgatcggacaatcaaaattaatctataatgatggtacattatcacaaatatatgattatagaaatgatagtttagtagcgggattaaaaatggcagtcacgagtgctcgaactttaaataatcagctattgcagcttgaagataatgtagggcagttatatagttttactgatcaacgagattttgaattagttgattttaatgaaaaagatgtaaatgatgggaatttaaaaataagttataaaacagaaaagaatggtttgatgtatgtttatgatcaaggaaatttgattgaaaagacaacagctaaaaactttaatgttaaattattagcaggagagcatgatttaatcttttcatataatgatggtcaaggaaaggttactcattatgctactgtaattacagtggaaaaaagcactattagtcgttatttgattatgttactggtaataggaattgttgctggcggctttggtttagtcttctacccaaaatatcgattaatgaaaaaggcaggtgttaaacatggataaattaattgtgattgaacatatggataaagtttttggtaattataaagcaattgatgatttgtcttttagtttagagggaggaaaaatttacggtatgattgggccgaatggagcaggaaagtcaacaactatgtcattgctgatgggcttgatttttccgaccaaagggagtggtttgatcaaagggtatccgttaggttctaatgaagcaaaggcaataatgggatattctccagaatttcctaatttttatagtgatatgagctgtttagaatatttagtctatatggggatgttgtctgatcttagctatgatgaagctttaaaacgaactaaggaattattagaagaatttgatttagttgaacatcagttgaaacgtgttgctaaattttcaacagggatgaaaaagaaagttggattgattcaagcaatgatgcataagccagagattttattactggatgaaccaaccgctaatttagatccaactagtcgttatgaaattattcaaactttaaaacgtttagtaaagcagcggaagatgacggttttaattagttcacatgttttaacggaattagaaatgatcattgatcatgttattatgatcaataaaggtcatgtagttttaaatcaacctattgatgtagttcaaaatgaatttaatcaagaaaaattacttgtaagctgtaatcataatgagcatttacaaacatatttagaaactaaagggtatttttatacgctcaataatggagttttaagagtaagtatagatgataaacaaaaatgtaaaaaagaaattgttaagtttatttatgaaaatgattatgaattagatttattaaaagaggatacgatttctctagaaggactatatcagcagttagtggaggaaaatgatcatgaaagtactattcagtaagacatttattaaaatgtttaagcttattccggttgttgcgtgtgtgattattagtggcttttttggttttatactatcaaatcaatatcttggtttaatgagtcaaaagccaacttatctttctttatcacaagatattttaatgttttatgcagttttagctttcgttttattagtaggaatgttgatctggattatttgttcgaatagtggttcgggacttttcgcaagtgaaattcacgaggggacaatgagattattattatcaaaaaaaatatcacgtttagagttagtaatcggtaaagtaggtggtatgctagtgggcagttttgtttatttggttatttcttttgcgacattcttaatggtctttattattttaagtggtgttgaaaaagatatattacggatggtattagcagctactcttgccttcattagttatggaataattttaatttttattcttgggggattagcgacttttctatcatcatgttttaaaaagaaagtacctgctattttaattctagtagcattagctgcactaatttttggaattatcccttttgcccgaattttccttacgaatactggaaaatatgatacctatcatttatatttatttgatattaattatcatctttcattgatctttaatcaatttttaatgctggttggagattttaatacaatgttaggtgatctaagcatgtttggaatgttcacaaatctttactcatatggtgtaactgattttgatttaggaaatcgtgctgtttatacattgaatcagtcactaaatagtggtttgattacagcagtttatctagccttagctagtggactgtatgttttatcttatcgccggatggataaaaaagacatttaatttagtactatataataatacaatgaatcttattatttgagtaatgtttttgactaccgcttttttagtagcaaagctgtatatccctttgaacaatagaggttcctttacggattataaaactagaagttatttacataataattttctagtttttttatgagaacttttttcaaaataagattaataaacactccgattaaaatctatgatattattaattagtaggaggattgagcgatgtatctagtatttgatattggtggaacagcaataaaatattgctggatgaacgaagcgggagaaatttttaataaacaagaaattttatcaacagcagtagacagcttagataaatttatagaaacagttgctaaaatataccacgaaagtaataggaaagttgaaggaattgctttatcatgtcccggtgttattgatgcagctaatggaacgatcaaagtcgttgttgcgtatccatatttacagggaatctgtttaactgagctaatttctaaagcttgtgataatataaaggtttctttggaaaatgatgctaagtgcgctggattggctgaagcctggattgggagtgcacaagcttatgatgatgcaataattgtagttttaggaactggaattggtggagcgattataaaaaataaacaaattcatcatggtgcacatttatttgctggtgaaataagtaccctgatcgttgattatgataaagagactaatcaagtattgacctggtcggacattgcttctacaacagctttatgtaagcgggcagcggaagctttagcagtcacgtcaattgatggaagacgtgtttttgaattggctaacaatgcggatgaagttgttctggaggtactgaaaaatttttgtctggatattgcaatacagttgtataaccttcagtatagttatgatccaggagtaatctgtattggtggaggaatttctaaacaacctctattgatcaagctgattaaagaggcggttgaaataattgctaacgagactaatcagctgcttaaaccaaatgtaacgacatgtaaattttataatgaagcaaacttaattggagcgctatcatactttcttagcataaaataatttgtttttttaccctaaaaaagtatcatattatcatcaatagtgttatagtataaaaggtgaatattggggaatgttcattcagtattcttattaaaagaaacatattgatgttaaaatgaatatggtttttaggaggatgatttatgggtgtttgtaaagttaaaaatattgtaattggtgagggtatgccaaagatatgtgtaccagttgttagcaacaatcatcaagatatcataacagacttgattagattacagtcattagatatagatttgattgaacttagaattgattatttcaatgaactgttagatcatcaaaaattaaccgaattatttaaagcaattgcttcaatggcaattaaacaaggaattattttaacttaccgaagtgttcctgaaggaggaaatggtaaattaagtaatgatgaatacatgcaattatattcaattgctcttgaaagtggagcatttgatatttatgatgttgaattatctagtggaactaataccgttattaatttaagtaatttaattcatcaaaatgataaaaaaatcattatgtctagtcatgattttactcgtactcctagtattgatacaatgttaggaaagataaaacaaatggattctttagaagctgatataattaagattgcagtgatgccagaagactatcgtgatgttttattgttattagaaacaacactaaaagctaatgagttatatgataaaccacttgttacaatgtctatgtcaagcaaaggaattgcaacaagaattttaggtgaacaatttggctcagcgatcacatttggaaaagataacaatagctctgctccaggtcaaattgaagttcatgctttaaaagaagtgttaaaagtgattcaccataataattaaggactatatgtccttttttttgcacctttttataatttacacataaaataaaataggtggttaaatgttaataaatcagaatgaattagaaaaattatgtaaatatttatatccaaaattttttgattataaagatattagcctttatgacttaaatattaagatcgacgactatttacatctaagtgcaaatttaaattattataatatagaaacaaagctgagagcaatagctcgggtaagagtcgaagataagattattattgatataaacggagttattaaatatggatttattaatttagatttaaataaagttttaaaggaaacggtcaaggatttgccatatttaacaatcaatgatgaaagtattattattgataatgagtatgttcgggagatatctttaaaagatgaatatataaatatagaactaaaataatcgtaagattattctagttctatttcaacatgataaatccgaccccagagataaatctgatagaaatatgctaataattgaggaccagtcatcagttgaccaaaccatggatatttaaaggattctccgccactattaattaaatcaattaatttatcacggttaaataaacgtagaagtagattattttcatcatttaatgattcttttaacaattctacgattaaatcacgatataatggtgaatgggttttaggataaggattcttttttcgattatagatatcacttggtagaaaatctttaaaagcatctcgtaatagacctttttcaatatcattgtgatacatatattcccatggcacattatataaatatgaaacaatatctttattagcgaaaggaactcgtaattcaatagaactacgcatcgtttgactatcagaacgagtcaataaagtctgcataaaccattccatatttaaatagatcattttacgcttattagcatcttcataagtatgatcatgataatcaatttcgtttaatgtttgatgatacttatccatgacatagtttttgatattcagtgcttgaatttcatcagagaatagttccattcgtttatctaaatcacgcatccatggaaagccgtcaatactgtaaagttcttttcgataaaaccatgggtagccaccaaaaatttcatccgcacattctccggaaagtacaactttatgattatgagaaatttcttttgaaaataataagaaacttgaatcaatatctgccatcccaggagcatcacgcgcaatcaatgattcttttaacgacatcactaattgtttttgggataaagttactgttttatgtttggtgttatacagtgtttttacttcatcgatatagtggtcgtcacgtgttgtttgatactcataaggttggaagtatttgtcttgatcttgatagtcgacactataagttgataatttggaaatatattggctagtaacaccagtgatgatcgaagaatcaaggccgccagatagcatgcatgatacagggacatcgctcaacaactgttggtgaatactatgatttacgagacagcggatatcatgaactgtttcttcgtaactccgattatgattacgtcgctcaagtgcccaataacgattgatttctttgtaaccgttaaagacattcatataatgtgctggtcgaagactatagatatctttataaatagttttaccaggcgaaacacttggccctagtcctaataattctttaagtcctgtttcatcaacgacacaacgccctaaatacattaaaatacattttatttcactactaaaaataaataaatcatctttttgataataataaagcggtttgacaccaagttgatcacgagccacaaaaagtttattttgatatgaaattacaaaagagaaaattccatcaaataaattaagacaacgtggaccgtaagcaataaaactagcaacaactacctcggtatcactttgactagtaaaatggtacccttcatcaattaattgctctttgatcgtattcatattgtaaatctcaccattatatacaatcgtatactcaatatcattataagtatatttaaatggttgtttaccgccatttaagtcaataattgataaccgacaatggcctaataaaacatgttcactactggcgatattaaaatcatcaggtccacgatattttaataatgtaagcatcttattaaagttttgaacttgattagttaaatcgttcatatagtcatacatacataaaaatccacacaaattaatcaccccgtatcattatatgaatgatactttttattatgtcaaaagataattttaaccgtgttttcttttttgattctccataaaaatgcgaaaaattaggtatatcaagggttttgcgctagcgtgaaaaatcacggtgaatgtgataaataatagaaaatatcaccttgtctctaactttggtcaaagtgttgtgtaacggctttcaaattgatacgatgtatgtgtcaagagaaaagggaggacaaaatatgttgcaaaaaattcaacgttttggtggggcaatgttcacgccggtactgttatttgcttttgcaggaacaactatcgggattggaacattgtttacaactgaagcaattatgggtggtctagctgaccctaatggattgtggtatcaagtatggaatgtcattcttcaagggggatggacagtattcaatcagttaccattaatcttcgtggttggattaccaatcggtcttgcgaaaaaacaacaagcaagatgttgtatggaagcgttagtactttatctaacatttcaatatttcttaagtacgatcttaagccaatggggaggaactttcggagttgacttcgcagcagaaactggaggtacaagtggtcttacgatgattgctagtattaaaactctagatatggggatgatcggagcgttaatgatttcatgtatcgttgtatatttacacaataaattctttgatactgaattacctgaatggttaggaacattcagtggttcatcattcgtagtaattgttggtttctttgctttattaccagttgcatttttatctgcatggttatggccaatcgttcaagatggtatgcgtgcattccaaggatttgttgctggtgctggatcaatcggggtatggatctttatcttcatggaacgtatcttaattccatttggattacatcatttaatgtatttcccattcttctacgattcagtaattatcaacggtggagtttattcagcttgggcaacagctttaccagatttagcggcttcaagtgattctttaaaatcattagcaccttgggcatggccaacacttacaggtttatctaaagtatttggatgtccaggtatcgcactagcattttatgcgacagctaaagataagaagaaaaaacaaattgctggtctattaattccaatcacattaacagctattgtttgtggaattacagaaccaattgaatttacattcttatttattgcaccagtattgtttgtagtacatgcagtattagctgctactttagctacagtagcaaatgcgctaggtgttgttggggtattatcaggtggtttgatcgaaatgtcagcccttaactttataccattaatggcttcacactggcaaacatatttaacattattggtagtaggtttagtctttacaggtatttatttcattgtatttagattcttgattttaaaatttgacttcaagacacctggtcgtgaagatgatgaagaagaaattaaattccacactaaagctgattttaaagaaaaacaagctggtggaaaggtagaaaaacaaagtttagctgctgctatccttgaaggattaggtggtaaagataacattgttgatgttactaactgtgcaactcgtttaagagttaatgtaaaagatgaaaaattagttcaatctgatagctattttaaatcaattggtactcatggtttaaaagctactaagacaaatattcaagtaattgttggattaaaagtaccaagtgtaagagaagattttgaagcattactataaataaatgaaaaggatggtcttgaagatggcaaaaagaattaatgaaaagaagttaaaaagattagatcgatattatatgatcgctaaagtgttcttaatggttacaccgtttattgcttatctatatttatcgttgttagcgatgatgcgttcaattactttgccagaagtgctgagcagtgagccaagtgtagcagtaattttcttgattgcaatgattaatccatatattgcttatttactaaatattgcacaaagaaaattaaaagaaggtgacattaaatttgcttgtattaacttcgtattattgcttttagctcaggccttaacattaaatagtttatattttatgattattgcttacttgttctatgtaacagttaaaacatatgatattaaagtattcaagacccttaaggaatttacaatgaagtacactttccagtatggtggaggaagcttcattgtagtagccttttcaaccgtttgtttatttgcgacgcttagattaatgtaaaacagaggagaaaaagaaaatggaaaagaaatattcagttgttattgctggtggtggaagtactttcacacctgggatttgtttattattgttagatcatatggatcgttttccaattagaaaaattaaattttatgataattttgcggaacgtcaagaaaccatcgctaaagcctgtgaaatttatttaaaagaaaatgcaccagaagttgagttcgcttatactactgatccagaagaagcttttactgatgttgacttcgttatgtgtcatattcgtgttggattatatgcaatgcgtgaaaaagatgaaaagattccaatgaaatataatgttgttggtcaagaaacttgtggtcctggtggaattgcttatggcatgcgttctattggcggggttattgaaattctggattacatggaaaaatattctccaaatgcctggatgttaaattattctaatccagctgccatcgtagctgaagcaacaagaagattacgtcctgattctaagatcttaaatatctgtgacatgccaatcgatcttgaagaaaagatggctaacatggtagggttaaagtcacgtaaagagatgtctgttggatattatggattaaaccactttggatggtggcataaaattgaagataaagacggtaatgacttaatgccggaaatcaagaagcatatggcagctaatggttttgcagatgcactgtcaggaacgaatcagcacgtggaacaaagctggattgaaacattcgcaaaagcaaaagatgtttatgcattagatccagaaacaatcccaaacacatatttaaaatattatttatatcctgattatgtagtagaacatactaatccggaacatacacgggcaaatgaagtaatggagcatcgagaaaagaatatctttacagcttgtagaaagatcattgaaaaaggaacagctgtagacggagggtttgaaccagatgcgcatgctgaatatattgttgacttagcttgtgcaattgctaaaaacactaaagaaaaaatgttattgatcgtaccgaatgaaggagcagtagaaaactttgaccgtacggcaatggtagagattccatgtatcgtaggaagcagcggatatgaaagaatctgtcagggatcaattccacaattccaaaagggattaatggaacaacaagtatcagtagagaaattagtagtagatgcatggataacaggaagctatcaaaaattatggcaagcaatcacattatcaaaaacagtaccaagtgcaagagtagcgaaattaatcttagatgatttaattgaagcgaataaagatttctggcctgaattgaaataagatgttaaaactatttaaaaagaaagaaaaacaaaataaagtactatcttcaatggctaacggaaaaagtgtagccattgaagatgtaccagatgaagttttttcaacaaaaatgatgggtgatggaattgctgtaattccagatgatggtaaaatttatgcgccatgtaatgggaaaatctcaatggtgatggataatacgaaacatgctttggggattgaaaccgaagatggtatggagttattaattcatgttggcttagacactgttaatttaatgggtgagggttttgccactcatgtatctgccggtgacagtgtagaaactggtgaattattaatttcttatgataaaacagattttgtgactaaaggaatcaatgatataacaatgttagttattgttgaaaatggtggtcatgaaatcacaaaatataatattaatgaaaatgttcatataatagaatctcctttaatcgaatacaaataaaatcacatcaaattgatgtggtttttctttactgtgataaattttttctaatttagttattgattttgttttacttaaaatattgttataataatacatgtagaggtatgatatgaaattagaagaactagttaataggaattatcaacaacttaatgataatgatttatatatatggaattatattattcatcatcgtaaagagtgtgagcgtttatcgattgatgaactagctttaagatgtagtgtttcacgaagtactattttacgcttttctaagcgtctgggtttaaaaggatacgctgaatttaaagtttttttacggatcgataatcaaaaaaatgataaaaatgctttaacagataatatctttaatcattatatagaaactttagaacaatatcgggattatcattataaagaaattgtacaaagtatttatgaagctaaaaatctttatgtttatggaactggggtaattcaagataatacagcgcaacatttaaaacgttcattttcaatggtgaataagttatttttagacattgatgtattagcagattttgaggcttatattaatttgtttggtagtaatgatgtttttattgctatttcttatgctggtgaaaatcaacgcttattagattatgtttatcgtttaaaagctaagggagtcattgttgtggctattattgctaataatgattgtactttatctcatgtggccgattatagtctgcatgtaaagacattaccagtcatgacaaatcaagggcgtcgtgaagatctggtggggaactattttattttaattgattttattattgccaattatattgaatatgctaaaagtagaggaaatgaataatgacattagataaattagtagaagataattaccatcaattgaatgaaaatgacttatatatctggcaatatattttacatcataaacgggaatgtcaaagaatttcgattaaagatctagcacgtaattgcaatgtatcgcatactagtattttacgctttacaaaaaagctggggcttgaggggtttagtgaattgaaggtgcatttgaaatgggacttggcgcaaaagccaaatttcaaaccacgaattatagacgatacttatcatgaatttattgaaacaatggaacgaatgaaaaatcgagatttaactaatatcatggaaatgattgaaaaagctgaacgagtttttgtttatggaactggagttgttcaagcaaatatggccggtgaactgcggcgggtttttctttatacaaacaaggtttttcatgctgtaggtaacggaacggaaatcgatacaatcttaaataatgtaactaaaaatgatttgtttattattatttcattatcgggcgataatgaaacagcagtaactttagcacgcgctttacgagggttacatattccaagaattggaattgctaaggttggaaatactttattatcaaagtattgtgatgatatgattacttttagatatgaaacgtttaaagtagggatgtcagatattctttatggtagtaccgcccacttctttattatttcagattttttatttttgagatacttagaatattcacaagagaaaggatagatgtaaagaggatgattaaatgaaactttaagagttatgaaaatttagttaaagataaaggccctttaatggctaattatgctttgatgggagatggtaaagttattgatggtgagctttacgaagaattacgaggtaccgaaggatgctgaaaatggcgatactattcatgtggtcgtagaagttcaagataatggtaaacatcagttgaaacattgtcaaagagttattattacagttaaatagttttatagcagctatattatttatatagctgctttttgttaagaaataaatagcttataaatgttttaaaggacgtcagtaatatgacgtccacaatgtttaattaatctttttttggtttatcagttactaattcttttaaagaactagctaaaccggcaataccttgaatctcactaggaataataatttttgtggcttcacctttagataactcttctaaggctttaaacccttgtaatgttacatatgcactgtctgggtttgcttgattaatatatgtgatacctttggcttgggcttcataaactaatcttaatgcttctgcttctccttcagcaattgcaattttagcttctttatctgctgttgcacgtaaaatcattgattctttatcaccttcagcatttaagatagcagcagtcttttttccttctgcttgtaagattgcttcacgtctttcgcgttcagctcgcatttgtttttccattgcttcttgaatatcccgaggtggaataatgtttttaacttcaacacgatgtactttgattccccatggatcagtagcctcatcaagaatactacgcattcttgagttaataatatctcttgatgtcaaagtttcatctaattctaaatccccaataatatttcttaatgtagttgctgttaaattctcgattgcgttgattggtcgatccacaccataagtaaatagttttggatcagtgatttgataataaacaacagtatcgatctgcatcgtgacgttatctttagtgataactggttgtggtgcgaagtcaacaacttgttcttttaatgaaactttattggcaactcgatcaaagaaaggaatcaagatgtgcaatccaacattacatgtacgattatatgctccgattctttctacgacatatgcccgtgattgtggaacaattctaattgttgaagcaatgatcgtaattacaataattcctagaaaaacccataatacaatagcgacaattccgtccataatatttccctctctattcttctatttttttaacaactaagtgagctccttcgattgccatgatttcgcagtactcaccctcgttaatagtgttattatcaacacttgcagctagccatgatgttgacataacttttacttcacctttagtatctgcagtaatcgtcttagttacaagcccatgcttaccaattacacgatcgtaattggttttttcaatatttgttcttaaatattttttagcaataggtcttgtaacaaagattgcgatcgttgtgacaattacaaacaaggcaatttgaattgcttggctagcccctaataaatcagcaattagggcaacaacaccacctgcagcaaaccagatgcttactagatcaatagtaataatttcaacaattattgctacgatgataatgcctaaccaaataggtatcatttataatccccctccttaaagatccactaacagaatctgatgtattacatcaaacttagcagtatactttacacagttgttattgtctaaatctaaattatattcttttgatagttcactaataaagtttttatttgaaattcgtccgtagctttttccaatggaaattctatgcaattgatcttctggatataacgcatcatttatttcttttttaccaactggcttaattcccaaaacatttttatttcgatcgattcctaataaaacaaaatctacttcttcaaagtgccgacaggctgctttatttaatgttagattggtgctgtagatagtaactgtttttttagcaatatcattagttgaccattcaaattccataagtatcaccctttctattactattatattataaaaattatttttattcaacaaaattattgaaataaaaaatagcagttatttctgctatttagcaacactatagaaattagtagtttgataattataaatgatatttgaagtgttaaataactgtccgtttgataaatgaatattatcattgatcataatggctggatcattttcttcaagttctagtaaagcagcatcttctttgcttaattttattgcagttagatatttatcagcaaaaccaaaagagatttttaaatcatcttttaaataattaaaaattgatccttcagcaatttccttacctaaatagggtacgatttccttattataatatgttcgctctaaagcatatgggataccgtcgacaatacgaagacgctttaagtaataaactggagttccaactttgcagttcatctgttcacttaacttttcatcagcttcaactatttgaatatctaataatttattaatgattttattaccgggattatccattgtcaccccacgggtcgagttaagatacactgttccttttttctttggggcccgaacaaacatcccgcttccttgaactggataaataatgcctaaattcattaatattttaattgcattacgaattgtattacgactaaccccatattcttcaatcagtttttcttcagtaggtaattttcgagtctcttcaaattcttcattcattatccttttttgaagatcatttacaatcatttcatactttaacatataatcacctcaaaactcattatatcatattagtcaagtttcacaatatttattggtatgaatataatttattctatttttattgtgaaagcgctttacattaattcttcattggaatataataaatttgtaccaataaatttggaggagaaaagatgaagagaatattgaagggagcattagtagctctaatggttgtttcatcaactattggggttaaagcagagtcgaagatttcagccgaagtacaaagaattattgatagtatgacaccggttgaaaaagtcgcacaaatgattcaggcggatactcgctggatcactccagctgaagtggcggagtataagattggttcaattcttagtggtgggggagcagcaccaactagtggaaatgaattaagtaattgggtaacttcagcaaatagttatcaaaaagcagtaattgatagtggtggtattccattgttatatggaatagatgcggttcatggaaataacaatttgtatggagcgactatctatcctcataacattggattggcagcagctaataatactcaattagttgaacaaattggggaggctactgcaagtgaagttagagcaatgggagccaactggacatttacaccaacattaggtgtacctcataacgaacgttgggggcgtacatatgaaacttttggtgatgatgttgaacgggtaactaatttaggtactgcatatattaaaggaattgaaagtgatggtgatactctatcgtcagcaaaacattatttaggagaaggattaactactaatggagctaaccaaggtaatgtagagcttagtgatgctgattatcaagatctaatcaatgcaaatatgaataatccaatggttaaggaacttttaacaccttataaagaagctattaaacaaggaactaaatcaattatggttacctataatagtatcaatggtaaaagatgtcatggaaataaggacgttgttacaacgttattaaaagaaaatcttggttttgatggcattgttattagcgattataacggtcttgatcaaattgagaatcaagcaacttataaagataaggcaattgcttgtatcaatgctggtgttgacgtcttgatggtagcagaaaaagatggttcaacaccacgctggaaaaatttatataatgctttagttgaagctgttaatgaaggaaaaattagtgaagaacgcttaaatgatgcagttgcaagaattctaactgctaaagaagaattaggatttttagataatccttcaaaagcatatgctgatgaggcagatcaagctaaatttggtggtagtgaacatcgggcattagctaaacaagcagttagcgaatctttagttttattaaaaaatgatgaagttaatgctggtaaaacagtgatgcaggctttagcagatatggataatatcgtggttgctggtagtgctggtgatgacattggtaaacaatgtggtggttggacaattacttggcaaggggcaactggaaatacaacacctggtacaactattttcagtggtttaaaagcagcgatggataaaaagggtggaacaatcagctataatgctaatggtgtatttacaaattcggacaataaagttgatgcagcaatagttgtagttggtgaagacccatatgctgaaagtaatggtgatcgcagtgctggacaattaaaattaccagctaatgatattagtacaattaaacggattgaaaatagtcatcctgatttaccgattattttagttttaacaacagggcgaccaattgcaatggctgattatgttaatgatgatcatatcaaagggattgttaatgcatggttaccaggtagtgaaggtgatggggttgctgatgtactattaggtgataaagattttgtaggaacaaatccaattacttggacatggtatcctcaagatattactagtaagtatgatgattcaagcaaagtattatatccggttggatatggattgaaaaaagctcaaaaaaccggtgattttacagcaccagctgatcctaatgtgatagatttagcgaaaactaatggaaaattagaagccgaggcgtttgtggatgcacacagtgaaattaagttagaaaataatggtacaactgtagggtatttacaagatggacggcatatgacttataaaattaatgtgccagaacaagcagcatataaattaactgttcaagcagcacgtgaatatgcagcgacaattgatggagcatttgaattatatttagatgatgaattggtactagaaaagaaaagtacaccaattgtttcaacgggcagctggactaagttcacagctcaagagatgacagctttggttagtttaaaagcggggatacacgaacttaaacttgtagcacgcgataaagattttaatattgattattatatttttgaaaaagctggtgattatgttggtccaatcattcctgatgaagtaacaaatgagggaactggagcaatgttacaagaaggagcagttgaagtaagcatgtcttcttctgaaaattcacaagatatggcttggtataaaggtgaatttgagatttctaataaaaatgcaacaaaagatcctcttgatttacgtgttgcagatgattctagtcaaacaacaattgttgtaaatgaccaaaaaacatatcaaagtgttttaggaatgggaacttcaattgaagaatcaacaatttacaatttattaaagatgactgatgaaaatcgtcaagctttcttaagaagattattagatcctgttaatggtatgggaatgtcgttaatgcgggtaacagtgggaacatcagattttacggcacaagacttctacacttattatgatggtacaggaaaagaattagatggtaaaccagattggaataatgttactggtaaaggatttagtattcaaaaagataaagatttaggaattattaaagttattaatgagatgcaggctatcgcaaaagaattaggagtagaagataatctgaaattctttgcttcatcttggacaccaccagggtggatgaagttacctacttcaagtagtaattcatatgaggataatgaattattattgaagggtggtaaattaaatgatgattatattgatgatttagctaaatatatggttcgttatgttgaagaatatcaaaaatgtggtattcctatctatgcaatgacgattcagaatgagccattattagaaattaattatcctagttgtgcaatgacaggaacccaagaagcaaaaattgctaaagcaatcaaagctgaattagcgaaaagcactgtgttaaaggataatgaaaaagaagttaaactatgggcgtttgatcataattttgatggtgctgataaatttatggctgatttctttaaagaagctggtgatcaattaaatattgatggtattgcattccatccttatggtggtaatgcttcaacaatgggttctttctatgatagatataaagatcaattaagtatgaacttaacggaaagatcagtatggggtactagtggtgctaatgatattattacttggttaagaaacggttctgaaagttataatagctgggttacgatgttagatagtaatgttggaactcatcattgggttggaactccagatccaacgttatttgtgcaggatgctaataatcctcaaagatattgggctactccagaagtatatatcatgtcgcaatttactaaatatgtaaaaccgggatatgtccgtgttgatacaaataatggttctagttcaactgtaacaaacgttgcgtttaaagatcctgaaacaggaaaaattgttatgattgttgcaaaccgaagtggtactgatcaaaaattcaaagtaatgatgaagggtgctcaatttaatgcggtattaccggctggtaatgttgcaacatatatttgggatggtagtgatattgaaataaatgcattagatgttccaggaacattcacagctgataaatgtagttcagctactaatgctaatattaatacaacagaccatattattgattatgtaaataaaaatgcgagtatagattatttggttgatgtaaaagaagccggaacatataatgttatgattaaagttgcttctggtgaagattgggaaaataaaacagtaaacgttaaatcaggtgatacagttgttggtactactgtggcacaaagatttaatttctggggtggtgaatggcaagattaccgttatatccaagctcaagcaaatctggaaaaaggaattcaaactctaacgatcgaattgccagatggcggtatgaatctaagtgaaattaagatcaataagacaaaatacagccatgatgtgcctgggtacattagtgctacagattactgttacggtgaaagaattattgtagaagatggaaatattggtttctttggtgagtacgaccgagttaattatcgggttaatgtacaaaaagctggcacttatcaaatgaagatgaactatgctagtgatggagaagcaaaattttggatggatttaattcaaaatggtatctctgcttcaattggtgaagcaacactctctagtactggtaacgatagcacttacagtactggggtagtagagattaatctgcctgaaggtgaaagccaaattagttttgtcccacaaagtggtgtaagttttaacttgaaagcattatcgtttggctcatatattcaaatttctagtgatgaattagaagaaggtaaattagctggtaaagaaattactgttaatttaaaagatggaaaatttgaaactgatttaaatcaagctaattgggtggttgaaggattgcctgcaggtattacttattctttaaagagaataaatgatacaaaagcagtaattatattaaaaggtaatgaagttgtagattatgatagtaatcttacagtgactgttaaagttgatgctggtgagattggtgatactggttatagtttgagtgatagtgtaatgattgctgcagttgatgatgacgaaacattattagatattggtgatcttgcttttggaacaactgaatttgatttaatgattgaaggcggaaaattcaatcaagatttaaaagtaaatgatcttgttttaagtgaagaagcagctaattatatgactgttaaagcgataaaagtaagtgctgatggaaacaaagtaacagtaacattagaacgtaaaaatactaattatgaagatgttgcagggacaattagtataaaatcaaacggttatagcgatggcaacgtcgatttaacagcaaatcttaaattattaaaaacaaataatctaccagatagtattgatgttggtgatgttgcggtaggattaaaagaaagtgatgcatatcgtaaaaaaggtactttggttaatggtgctaagggagattatattgacttctatttgaatattaaagaagaaggaaattatgtattgacatataagattaaagatagtgaagcaattactaatggtttaaaactaagtggtggtttaggattggctactgataatcttggcagtgtttcttttggtaaatattggggaaatgcacaaggttatgcacagatgttgaatttaaaagctggtgaacagactttaagatttgaagttaatagtgctggttttgaattaactaatttaaaaatcgaaaaattaactcaagcaattgaagttagtgatacgcttgatcaaacaacgacgataacggctgacaaggtagttgatggttctaaagaaattggttgggggattgaaggttcaacaactaaaaatattggttttggatctgcaggagcttatcaagattattatcttgatgtaaagacggcaggattatacgatgtaaaggttaattatagtcatgattgcggtggcgatactaaagctgttatcatgacagtagatggaaaaataactgctactttgggtgaagttactttaaagaattctggtggctggtcaaattggaaagatagtgacacgattcaaattaaattagaagctggtaaacaatttattcgtatttatgatgatctagacggctttaattatcgtaatttccaattaacatttaaaggggaacaggatgtcactgctccagaaattacgggtaatgatgcagttatctatgtaaatgatgcaacagatattaaagatttactaggattaatagttactgatgatgttgatggtgatttattagataaagtaacaattagtggcgaatataattacaatgttgcaggaacttatacgattacagtgactgtaagtgatgaagctggtaatgaaacaagtaaagaatttacagttaaagtagttgaacctgcaaaattaattgttgaagataaagtattaacagttggcgataaatttgatccattagctggtatacaagttttagatgttgatggtacggatattactaaaaatattattgtaattagtgatggtgttgatacaagtaaagcgggaagttatgaagttatttacagaataactgatgctttaggtaatgaagtagaatttagaagaacggttgaagttaaggacatcgaaccagatgttaaaccagttgatcctgatgagcaaataccatcagataatagtggtcaacagactattccaggacaagtagttgaagcagctaagactagtgatgatgtaaatatcacgggtatgtttggtatacttgtattagctggattaggatggattggatcaagaaaaagaaaattttgtgattgttagataaaactctctctccttgcgataaggactcacattgtgggtccttatctttttttataacagcatataacagttgacaatcagttatacgctgttatatactgtttgtgaagaggagggagaagatgaagattatcataaataattcatcgatgcagccaatctatgaacaacttgttgaacaaataaaagctcaaatcataaatggtcaattgcatgaaaatgatgtattaccatcagttcgtgcgttatcaaaagaattaaagataagcgcattaacagttaaaaaggcgtatgatcatcttgaagcagaaggatttacagcaacgattcatggcaaaggtacttatgtaaagggggcgaatcaagagttgttgttggaggagcggcgcaaagaagtcgaaactgaactggaaagtaccattgataaaggaagacgttacgggatgaacgacgatgagataaaagctttatttaatttgattatggaggaataagatatgttagaactaattaatgtgcaaaaagattatggacgttttaagcttaattgttctttagaagttaaggctggttgtgttactgggctgatcggacaaaatggtgctggtaaaagtactacttttaaagctgttttgggtctgatttcagtagatagtgggactgttaaattatttagcaaagatattaaaagattaagtatagaagataaacaaaatattggggtcgtgttatcggattcgggatttagtgaatatctgaggattgaagatatcatccctattatggaatcactgtatcgtcattttgataaacagatgtttattgaaagagttcgtcattttgaattaccattaaacaaacaaatcaaagaattttcaacgggaatgaaagtaaaattaaaagttttgattgctttatcacaccaaagtaagttattgattttagatgagccaacagcaggcttagatgttattgtgcgagatgaattgctggatatgcttcgtgattatatggaacaaaatgaagattgtgcaatcattattagttctcatatttccagtgatttagaaggactatgtgatgatttatatatgattgatcagggtaaaattgttatgcatgaagaaacagatgtattattaagtgactatgcgattttgaaagttgatgaggaacagttttatgaattagataaacaatatttgctttgtcaaaagaaagaaagttttggataccgctgtttaactaatcagaaacaattttatttagaaaattatcctgacgtggttattgaaaaaagtagtattgatgaggtaatgacattaatgattaggggtgaaaaataatgaaaggcctatatattaaagattttaaattaatgatgaatcaaaagatgttttttatcgtaattgcagcaatggcaatattttttgcggttacccagacaaatatattttttgtaattagttatgctacttttattgccgcaatgttcgttataagcagtattagttatgatgaatttaataatggtaatgcgtttctctttactttaccagtgacaagaactggatatgtcaaagaaaaatatttatttgcagctactttggcgaccggggcatggctggcagctacaattttatcgatagtggttgtttttattcaaggaactgaggttattattttggagtggtttttaactgcggcaatgatcttgttagtggcattaatgatggtcttaataataattccagttcaacttaaatttggtcaaagtaaaggaaatgtagcaatgctgttagttatgggtggtgcttttgcaattggctatttagttgtgtcagttctttcaaattttggaattgatgtatttgcgatgattgatgcattaagcacgattggattaagcgggttgttgatgattttactcttaatggttgctggtgcggggataatatcgtatttgattagttgtaaaattatgacagaaaaagagttttgatgataatgagcaatgaaaaaaatattaaagatattagtgattgttatctttgttactagtttactaggatgtcaagataagtatcatgaaacatatactttgcggtattattatattgaaggttgtgctaattgtgaattttttacaaaaaaagggattcctctaatcgaaaaagaatttggaaaacatatgaagatcgttaaatataatatggatgatgcaacttcgtttgataaagttaaaaaagcttatgatcatgatcttgaacagcttcaggattttgattatgatcaatatggtgttgggccgtttttagtcctcgagaatcattatgctcaattaggagtttatgatattgaaaaatttttaaataatttaattagagcagttagtggtgagaaattgatggcaccagaaaaaatcgaaaaatactattattttaaagataattaaaaaagtatctattcttaatgagtagatgctttttgcattagtatacatttagataattttgggttataataacgagtgaggtgtaatatgaaaaaaatatttaaaatcatgataaccttggtactcactgtaagtttatttggttgtcaaaaaaaggaaaagaatgtttatacagaaacatatacattacagtacttttatttagaagggtgtcctaattgtgagaacttcacaaaaaatggtttacctttaataaaagaagagtttggtgatcatatgaaaattattgaatatgatatggatgatacagagactcttacagaagtaaaggctgcctatgatgaagtaatcaatagcattattgattttaatcaagatgattatggatttggtccttttttagttcttgagggatattatgctcaattaggagttagtgatgttgatgattatttagaaaatctaatagcagcaataaaaggtgaagaattaaatgaacctggagagattgatacgtattattatttaagagatggaaaggtaaaggaggaataaatatggccacaccacataatcaagcgaccaaaggagaaatagcaaaaacagtattgatgccgggagatcctttaagagcaaaatttttagcagaaacttatttagagaatgtaaaacagtttaatacagttcgtaatatgttcggatatacgggaacttataaaggaaaagaagtatcaatcatgggttcgggaatggggatgccatcgattggaatttatagttatgaattatttagtcagtatgatgtagaaaatattataaggatcggttcatgtggttcttttaaagaaaatgtgcatttaagagatattattattgttcaagggtgctgtacggattctaattttgctcatcaatatgaattaccgggtacttatagtgctatttctagttatgctttattagagcgggcagttaataaagctaaagaaaaagacgttgtttaccatgttggtaatgttttagcatcagatattttttatcatgctgatcaaggttcagttgaaaaatgggcatcaatgggttgtcttggagtagaaatggaatcatatgctttatttgctactgcagcctatttaaataagcgtgctttaacattgttaacagtatctgattcattggtgtcaaatgaagaaacgtcccctgaggaaagagaaaagacatttacagcgatgatggaaattgctttggagattgcttaatgaagcaaaagtttgcgttttttgattatgatgatactttgattcatggtgattcaggaagagcactattaaaatattatttaaaaaaacatcctttagcagtatttagactgctaaaggtagcagttgcttttcctttatcgataattgggttagtaaaatttcaaacggctaaaagtgcctggttgtttccaatggataatttaagtgatgaagagcttaatgatttttatcaaacatgtcttattcctaaatattatcctaatgtagttgcagaattaaaagataaaaaaaatgacggttatcttgtttatatctgttcagcatcgattgaaggttacttaagattttgtgatctgccggtagatgggatattaggaacgaaaacagaggtaatcggaggcaaatatacaagtcgaatgattggtaataattgtaaaaacgaagaaaaggtaacacggttaactgcggttatagcgaaattaggggttgagatagactatgaaaattcatatgcttattctgattcaatgcacgatattccaatgttaaaaatggttaaaaatagaattagaataaataaaaaaaatggagaaatgactccattcataattgaagagtagattactactcttttattttgtatctaaatcagtaaatagtagcataatattaataataccggcaataccaactaaaatatatattaacattgataaaaagctatcaacaccaaatagagaatcaactaggttgaaattgaataaaccgattaagccccagtttatcgctccgataattgttaatactaatgaaattttttgtaatatattcattatcttcatcctccttattaaagtgtatccattagaaatatctttatacataatatttatttttaaacatatttattattgggggtgtaaatttgaaaaaaatatatattggtattgccgcggcagttgtgatagtaatcgcagcgttaactttctttaaaatgaaagatagttctttagataaggtgattgaaaaggttaaggcttatgataaatatgcacttacttgtaatatggaaatggttgaaaatgatgaacttaaaagttatctagtcaatgttagttatttaaaagaaaaaaagaatgaatattataaagtagaattatatgataaatcattgaatcaatcacaaatcattgttaagaaccctgatggtgtttttgttttaacaccaactttaaatcaaatctttaaatttcaaagtgagtggccgaataattccccaaaaccatacatctatcaatctctaattgaattattagaaaaaggcgaagtggaaaaaataaaaacaggttatcaagttaaatgtgaagtgacttatccaaatgattcacgggtggtagctcaagaaattatttttgataaatcattagcgccaaagcaagtaaccgttttagataaagacgaagctgaaataattaccgctgattttactgattttaagacagatgttaaattgggaaaagataattttaatgagaagaaggttttagaaaagagtactaatgagtattctaatgtttctagtgagttaccattatatccagttgccttaatgggaagcactttagatagtgaaaaagtttcaacgattgatgggacaactaaccatattttaaaattcactggagataagaattttacagtaattgaaacaccggtaactgctagtgaagaagttgcagttgaaacggtaagtggtgaagtaattgatcttgttgatggtgtggcattttataatgatggtcaattaatgatgatgaaatcaggtgttttatgcaaattgtattctcaagatttaaataaagatgaaatggtcaatgtaatcagtagtatgcagacatcgagtttaaaatagaggcaaaatgcctctaatacataattatgaaaatatttgaattatcaattagattggattatacttagacaagatggaggtgtcatatgagtttacatcgtgatacatatgcagaaattaatttaaaatatttaaaagaaaatattgaaacaacatataaaaaatttaaacgtccgttaatggcggtaattaaagcggatgcttatggtcatggatatcgagaagtggccacatatattaaagatattgaatatcttgagatgtttgcagtagcaaccttaccggaagcaattgagttacgtgaattaggtattactaaaggaattttaattttaggagctgttccaacttctaaggaagaaattgatttagcaattaaatatgatatttctttaacaatgatctccttggattacatgcatcatctagaaacattgatagatcaacagccgttgaaaatccatattaaattagatacgggaatgcatcgtattggcttaactagcaaagcacagttggatgagatgttaaatactattgattacaataagtttatcttagaaggaatttttacgcattatgcaacagctgatggtgaacaggcagcttttgaccagcaaagagaacttttttatgatttagtagctgatcataaatttaaatatattcattgttgtaatagtgcggcaatggcttatcatcatgatgatcgttctaatttagggagaattggaattattatgtatgggatcgatccagctggtaatgaaacaaaggaatttaaacaggtaatgtctttatattctaaagttgctctgattaaaaaaattaaagctggtgaccgagttggttacggcttgacttacactgctgatgaagatgaatatttagcaacgatcccaattggctatgctgatggattgattcgtaaaaatcaggggcggaacgtttatattaatggtaaatattttgaaattgttggtcgtgtttgcatggatcaaataatggttcgggtagatgaaacgattaaagaaggggataaggtagagatttttggagcgcatataagtttagcgagcatggcaagagaacttgaaacgattccttatgaaataatttgtttgattactaaacgagttgaccgtttatatataaaataaaaaaacagtacaatgatgtaaaatctaaatgttagcgagagactgactataatagatacatcattatgctgttttttatttgtacaattgacttaatcggtaatatgataaagcaccagtcttagctgttttgacttttcctttttcatatactaatgtttgtggtaccgtaccatcagtgatatcgagtttttcttctagccaagtagtataatcactgtcaccagaaacgtctacatagtatagagatttactacgatttttttctacaaatgtggtcatggtttgttgatatgataatgttgtattatcactattatttccgataactacgacaaaactatccttatctttaactttttctactaatgcactttgagtaatcgttgtgtattcaacatgggttattttccgatatacaaataatccaatgaacactactaatacgattccaaagatgctaatttctttccacaatttctttactttttccatgattagcctccataatatacctttatataataacaaatatttcagctaaaaacaatatataataaagggatatgatgtgacatatcccatagttaaacttatttatgttttaaagcataattccaagtgtcgcgacacatctcgtcaattcctttggtagctacccaatcaagctcttccttggcgcgagcaggattagcataacaagtagcgatatccccaggacgacgatctttaataacgtatttaacttttacattattgactctttcgaaagctttaactaaatcaagaacactatatcctgtacctgtaccaagattacaaatatggactccaggattagcataatgttcaattgcttttacatgccctttagctaagtcaacaacatgaatataatcacgaacgccagttccgtcatgtgtatcataatcatcaccaaatacacctaagcattctaattcaccagttgcaactttcatgatatatggcattaaattgttaggaatccctttaggatcttcaccaatcaatccagattcatgggctccgattggattaaagtaacgtaacaatgttactgacatttctgggcatgcatgttgaacgtcagttaaaattctttccatcattgctttgctagtaccgtatgggttagttgtttcacctaacttacaatcttcagtaattggaacggtttctgggtcaccataaactgtagcactagatgaaaaaacaatttgattaacatgatattttttcatcattttactaacgatcaaagttgttgttaagttattagtataatattcaattggtttttcaacagattctccgacagctttaaatgctgcacaatgaattacggcatcaagtttattttccttaaagacagcttcagttttttcctcatctaaaatattaaattcataaaattttacttctttaccagtgatttgtttaatataccccaatacttcaggtcttgaattagagaagtcatcaatcacagtaacttcataaccagcatttaataattctacacaaatgtggctcccgatatatccggttccaccgcaaacaagtacgttcatcactatacctcctaatatgttttaataataccatttttaactttttaataaaagggattagataaaataatcgagcatatcattgaagatatgctcgacattttatttattgagaactgctttaactatgttatcgctagcaaattcataatctaaaaattccatttcaaagacaccttgaccttgtgtgattgaacgtagatcaacggcataattcatcacttcactcattggtgcttctgcaacgattttgattagaccgtcatttaaaacatcactgccaattacccgagcacgtttagtattaaagttactcatgatgtcaccagtgtattgttcatcaacgaccaccttcattttcatatatggctctaataaggcgggacttgcttttaggatagcttctttaaagcacattgcagttgcagttttaaaggccatttccgatgaatcaacgttatgataggcaccatcaatcagagtagctttaatgcctaaaacagggtaaccggctaaaacaccacttttaacgctttccattaatcccttctcaactgcaggaaaataagatttaggaactgcaccgccaaatactttttcttcaaaaagatatgattgactgtaatcgtaggtaggctcgaaagtaatttcgacttcgccgaattggccatgaccacctgattgttttttgaatctggttctttgggtaatgctctttttaattgtttctcgatatggaatcttgatattttctaaagtcgcttcgactttaaatttgctttttaatttatttaacatcatatctaaatgaatgtctccaattccatagatgcattgttgttttgtttcaggattactttcgaattttaaagtagggtcttcttctaagagtttattaattgcatttgcaattttttcctcattacttttacctaagggaacgattgctttaccgtaatatggagttgaaaattcaatctctggaacaataatttgataaccagcaatgcacaatgtatcattagtttttgaataactaagttttgtaactgcgccaatatcaccagcatgaagacaatcgacctcgattaaatctttccccctaggttgatatagtttagcgattcgttcgacttctttttcttttacattatataatgaactaccgctataaagggttccggtaacgaccttaaacaatgtagttcggccgatgaaaggatctgcaattgttttaaagataaaaatacttgcaggaagactttcgtcataaccgatgatttcttcttcatcagtgtcgatattttttacgattaatgaatttgtcatgtcaccagcagcgctaaagaatgcaacgattgaatttaaaataatttgaataccaatttgatcagttccgcataaaacgggaataagagtgcgctccattacccctttacgaagtgcccaggaaatttcttctttcgtaaatggttcttcattaatatacttttctaatagttcatcactggtattagcaacggcttcgtcaatcatttctttaattggccgaacttgttccatcaattcaataggaatatcagttgccttggtttgctctccatcaaaaattcgtccctccattttagctacattaacataaccgaccattttattattatccatgattggtacttggatgggagcaatggctttgccatacgtatcctttaattgttgcagtttagttgcatagtcactgctagggttatctaatccgttaatatagatgattttggctttatctttagctctaaacatcgcttgttttgtaccggcactgattcccgctgaagaaggaacgacgatcaaagctgattcacaaacacttagagctgcttcgcattcaccaacaaagtcaaaaattcctggaacatcaactaaattgattttacagttattccattcaacaggaataacagctaaattgacagatgactgacgttttatttcttcttcactatagtcgcttaaagtattgccttcgctaatacttccggttcgattaatgatgccgctgcgatatgccattgcttcaacgatgcttgttttaccgcatccagagtgccccaagacagcaacatttccgatttcgttcgcatgataagttctcataaaataccacctttctataaatgaacttctttcttttattttatcataatgacagaaaaaattattgtaatataataataaaaaagagcgcttacatatgttggtttgtaaatttcttttagtgttataatgaattgtttattttgtttagagctttcaatgcatacacgtgcgcagtttttcctaaaacttttaattaaagacttatttttggcaagatattcaattaaaaggagtattgattattgaaaaatagctaagcaagtaaatgattagattactttttcatttttaacatatttagtattatcatgctgagtatttttattaatctgttcagtctaggattttatcaaaaaacagttaagtcaaatatagttataaatttttattttacctatctctaaaatttatggagtgattagatttcaagttgtttccaatatgaatagttatatgaggatattttatctatttaataaatgctcattataaaatgagttttaacagaaaaaattaaaaaaattgcaaaaaagtgttgaccttttgtttgataattgttatatttatatggcagtcaacgagacactggaggtttagctcagttgggagagcatctgccttacaagcagagggtcagcggttcgagcccgttaacctccaccatttaaaataaaataggccggcttagctcaattggtagagcaactgacttgtaatcagtaggttgagggttcaagtcctttagccggcaccatgatggaggagtagcgaagtggctaaacgcggctgactgtaactcagttcctttggttcggtggttcgaatccgccctcctccaccattcattggggtatagccaagcggtaaggcaacagactttgactctgtcatctccctggttcgaatccaggtaccccagccattaataatgacccgctagctcagctggtagagcatctgacttttaatcagagggtcaggcgttcgaatcgcctgcgggtcaccatttaaatttttatagccacgcccaggtggcgaaactggtagacgcacaggacttaaaatcctgcggaccttaaaatccgtgccggttcgattccggccctgggcaccatttctgcgggtgtagttcaatggtagaacttcagccttccaagctgactacgtgggttcgattcccatcacccgctccataatggagttaacacacttactaagtaagtgtgtttttttgtattattacctaactgacagctttcttttttcaataacaattgctgatataattaaaacaagtgaaagtaaaagggaataaattattcctgaagtcggtaaaacgtttttgttttctagagctgaaagcgtagtcataacttgtttttgagggaaaaattgaacaacataattaaaaatttcattatttgttacttgagtgatcccgccagagacaatagttccaataattgcaaacatatttccaaacatcatactttcttccaaagattttgataagacattactccaaagaccgaatgaagttgcaaagaaacataaaagtgctaagattaaaatgaatttccagagtgcaatcgataaagtgatcttaaaaacaaaaagagcactgcaaatgattatcgtggcaggaataaaaagaaaaatataaacaacaataaaatgactcaataaatactgataacaacttactgaagtactcaagatgcgtttgttgatgccagttcgttcatcaaagtaatatttataaatttgtccgccaagaagaagtatcaccatcattaagaagcctaatatatttgaagcactgccacgctgattatcattaacgggtaagctgtctatttgaccatttattaagagggtgatagtttggttatacgtttcacctttagtggataagacatcaatatttttatcatcttggactattatggcatcatattgatttaagacaagttcggaggtactaggaagagtatctagataagtatatttgatctgagaattttgagatgtgtcaatatctcccacgattcctatttgtattgtatgagaaatgctgttggtaaagtatattgcaagtgcaatgataataggaatcaaaacaagataagtaattagaaatgctttgttgtgcttgattcgatataatattagttttatgagtttgtacattctttttcctcctaaatatagtcttctggacgatagtttttatggacaacaagtagtaaaagtgaagatagtgtcaaaagagcaaacatgatccaccagtaattagtactttgtccatcgtaaattaattgaaaaatacaatcgacagtccatttgattggtgaaaaacttgcaatcttttcaaaaatagcacctaaactcgcgattgggaaaaagattccagatagaaagcctaatacagacattgagtttgataaaataacatttgtgagttcttcactatgaagagtaacacaaatagcactgcttaatattgtaaggaatagaacaaagtttattattaagagaattacatatccgattttatcactaccgaagtttaccaatgatatcgtatcaaaaataatgatattgattgttaaggcaagtgccatgaataaaaaacatgtgagaatctttgagctgtagatcgacacgcgagatacagggctgtaaaagattcgggtatttccgtttttgatatgcttttctagaaaagcattagcagggacagtagcgcccatcatcgcaataaaaaatatcattgttacaccgtaaaaatcataggaactgattatagttgtatgatataaattatcaaataaaaaccccattaataaaattaagattgtaggaaaaataagaaaaacagataaggtacctgggctggaaataagattatatagatcgtgtttaaataaagtccaaaattttatcatgatcaatcccttagcttcttcccggttagacctaaaaataccatctctaaatttccttcttctgtttccattttattaatatgacattttttgtgaacaaaaagcataatgatcttatctaatgcgtcgtaatttttagaaactgtgattttaaaattatctgcattagttttgatctcttcaacaccattgatagtacttagtgatattgctagatcggctggaaaattatcagcatagatggtgtagataagagtgtctttatatttggctaaaagttcttttaatgttccttcggcgatcttagtgcctctatccataataacgattcgatcagcgatttcttcaacttcttccatataatgggtcgtataaataatagttgtacctttttcttttaactcctttaatgaggataaaatataattccgtgattgtggatcaattcctacggttggttcatctagaattaataatttaggattatgggcaattgcacaggctatatttaaacgtcgtttcattccaccactaaaggttctaggatcatcattttttttatcggataagccgacaaaagttaaggcattcattacttgttttggtaaatctttctttttaacaccgtataatgaagcgaaaaaggctacattatgataggctgaaatatcttcgtataatgcaatttcttgagggacaataccgagttgagcttttattttattagagtgagatgttaaggacaagttaaatatgttaatggtgccagtatcactggttaaaagtgttgatagaatattgattgtggtacttttaccagcaccattaggccctaataagccaagaatctcaccatcatagacgttgaaagataagttattgatagccttgttatgctggtagcttttattaatatttttaacttctaagatttttttcatattatttcctcctatctacaatatagctgatttagtttgtagagactacaaactctactttgcttttaaggaactattggttgcaaagctggttgcgaataaaaaaatgatattttttataaaaaagtgttgcagatcatatagagataatgttaatatataagtaacgaaaatgaaatgcgggtgtagttcaatggtagaacttcagccttccaagctgactacgtgggttcgattcccatcacccgctccataatggagttaacacgcttacttagtaagtgtgtttttttgtgaaatgatgctaataagatgcaattttgatgtacgatgaaagtaatagaggtgatactatgaataaaattttgatcgttgaagacgaacaggcaatttgtagactaattaagattaacttatcagatgctggatatagctgcaaatgtgcttatgatgggaaaggagcaattgaattaattgagtataatcaatttgatttaattttactagatattatgttaccagaaattaatggctatgaattaatggaatatattcgtcctttagaaattccagtgatttttttaacggctaaaggtgatgtaaaagatcgggttaagggattgaaactgggagctgaggattatattgttaagccttttgagattattgaattagttgctcgggtagaaacggtactgcgccgttatcataaaacatcaacagttttaagtgtttatgatattagtgtagatacactttcacgagtagtgaagaaaaatgatcaagtaatcaacctaacagtaaaagaatatgatttgctactgttgtttattcaaaataaaaatattgctcttttccgtgatcgaatttatgaagcggtatggggtgattattatatgggagatagccgaactgttgatcttcatgtacagcgaatgcgaaaaaagcttggattggaagataaaatcgtaccagtttacaaagttggttatcgtttggagggagattgatgaattttttttggaagctgtattttagtatcatggcaataacgctcacctgttttagtgtgggtggctatatgctgattcaaacgagcttcgataattccttcgaacgcgaagtggaggctgtttatcaagaaaatgatattttagttaattcgttaactttagaattgctctcacatctagaggaacttacgataaaaggcggaacttttcaagaacggcttgatttgcttaaaaacttagtttctaatatgacagttgagacatttaatggtaatgtttcgttttgtattcgagcggaaaatggagatgtagtatatcaaaatgatacttttaatgatgaccataaattgtttgataaaatatctcaaaatgagcgggggtatattgttcaaaaagataaggagcattataagttacaatctcttcgaatcttttctttgaatgggactaagttgtattttgaaaatgcgcgagatatttctgaactttttttaaatcgtgaaaatcaatttggaacactgttttattatacgattatattattattagctagtggagcagttatttttgctgtaactagatggttggttagcccaatcaaaaagctgtctaaagctactaaaggggtggctgatggacatttgattgttcctgtagtagttagcagtgaggatgagatcggtcagttaacaaaagattttaatactatgactgagcgtttgagtacaacgatgaaagaactgcatgaagcggttgaacgtcaagaagtatttgtcggaaattttgcccatgaattaaaaacacctctgacgtcgatcattggttatggtgatatgttacgttcgaaacgtttgaatgaagaagaagttattggctattctaatttgattgttgaagaaggaagacgtcttgaggcaatgtcaatgaaactgcttgaattgattgttttgaaaaaacaggattttaaaatgtattgggttacagctgagacattttttcaaggaattgtagatactgtagatttattgatgaaagagcagcaaattgagtttattattgaaattgagcctggaaaattgtatattgaaccagatttaatgaagacagtgtgtttaaatttacttgataatgcccgtaaagcagttggacaaaacggtaaagtatatttaagaggaaaggtattggcaacagggtatcagtttgttgtcaaagataatggttgtggtattgcagcaacggaattgagtaaaattaaagaagcattttacatggttgataaatcacgttcacgaagtgctggcggggctgggttaggtttagcgatatgtgaacagattattgaactgcatcatgcatcaattaattttgaaagtgttttgggacagggaactactgtaaccgttgttttagaaggagtgaaagttgatgaggtatagtaaaaatattattaaatttgcagctgcaataattttgttgatcatcattccgttagttccgttaacagtttctaaaatacaagatgataaattaattgagcatcttcaggtcgaaaaaataaaaagtgataataatgaaattcaaacaagtaagttgacagtcgctgaaaaattagagttgattggtgactatgaaaataaggaaaaaaatattattactacgacacaagttcaagatatgagtgatgaaaatattacgagaatccgaacgatcattaatgagcaattagttatattgaagaatcttggtattttaactgattttaattttgacggaaattatgtgtgttataattatacattaagacgctatagtaatgtgattgattctagtaaaagtgtcagtgtttatcaggtgaattttacgaatgaagaaggaatctttaatgccactatagatgttgatacgcacttaatatatcaatataattattataataaaaaatatatagcaagaaattatgaagtgatttatacttttggaacagcatatcttggtttgactgaacaagaaacttataagtatttattcggaataattgataatcgcaccgattcagtaagtgtttctagttataatgatatttattgatacaactttgatgcttctttggtgatgtttctatgcatctcttttatacacttgaaagtgtaaaagagatgtttttttattgaaaggggtaaggtgaagtgaaacagattaataaaatgaaagtgttagtaattactttgttgatgattgggttggttatgagtttatttattttagttaacgatcaagttaatcaaagtaataatcagctgatagctgctaataaggttaaaactaaccaaaataaatcggctaatagtgtggttaaagatgaattattaacattggttaattttgaaaatacgatacctaaagattggaaagttgatttagtgcaattgaataatggacaatcagtcgatcggcgaatttacgatgatttaatagcaatgttacaagcggctaaaagtgagggattaaatccattgatttgttcttcctatcggacaaatgagaagcaagaacaactttatcaaaataaagtaagtgaatatttaagtcagggatattcaaaggtggaagctagcgataaagcagctttttgggtggcaagaccgggaactagtgaacatcagttaggtttagcagtagatattgtttcaacaaaaaatcagcgccttgatcgtagccaggaaaacacagttgaacaacaatggctaatccaaaatagttggaagtatgggtttgttttgcgctatccgactaataaaaatagtattacaggggtagggtatgaaccatggcattatcgttatgttgggaaagaacacgctaaaaaaataaatgagctgggtgtgtgtttagaagaatatgtaaaataaaggaaaatgataaaagtttatattgaattcacatcagtgtataatatttatacgtgaggtgatataagtgacaaaaagatttgagtttgatgatgatttagaggagttagatatagatgagccagaacaagatgaagcggtggaggagacgggaaataaaaagcaacgtcgtccaaaaactaagaaaaagaaagtaacaaaaacaaagcgaaaaacaaagactaaaactaaagtgaaaaaggaaaaacaaggacgttctaagttttcaacttttattttatcattattgatcttgcttattattaccggagcatgtgttggcggttattttgcttatgaatattacatagatcaacaaaagcagattgataatttgcaagagcagttagatgattccaagaaagaaaataattctactaagcaaaaagaaaataagaatgatactaaaaaaaaggataatcaacaaagcgatgatgctggtactgatgaacctccagttgaagataatacttcgaatggaaatacttctgatcaagaaggaacgaatgatacgaataatgaaactaccgaaatgcaatgaactgtgagcatatcggtggtttttttcttaacaaaggcaaacaagaaaagaaacaaaaaaattgcgaatttttttaaaaattacttgcaatcatattttattaatgttattatagacaagcagtagtcgttaggacctctgctaagaagacaatgcgggtgtagttcaatggtagaacttcagccttccaagctgactacgtgggttcgattcccatcacccgctccattgcttgaatagctcagttggtagagcaatcggctgttaaccgatcggtcgtaggttcgagtcctacttcaagcgccatggcctgttggagaaacggttaactcacatgcctttcacgcatgcattcacgggttcgaatcccgtacaggtcaccatttgtaagttagtccaggatatttatcttggatttttattttgtttaaaaaataactgataaaagaaaaagaacctaacataaaattgaactaggttcttttaacaattaattagttattatcattttttaaaccgtcaatgatatttaatttcttaattttttgactgctgaaagcaagggtggtaaaaacaattacaaaaattgcaatagttataatgataaaactattgattggaacactgaatgaccgctcaaatattgcagctagattttcatataaaaagtacatgatgataaagcctagaggcaaactgtaaattagagttttaatgccatagaatagactttcaaaataaatcatcttattaaatgctcttggtgtcattccgatagattttaacattgaaaattcttttgttcttaatgccatactagtagaaatcgtattgatgatgtttgcgatactgattaaaccgattaaaatgataaagccatatgtgaagatgttaatgattaaaataagctggtttgcctgcttgatatcttcacttaggttaaagctgtatagtgattcttcaggataattatcggtaatttctttgatttcttttaaaactgcttcattattattactcgtataataaatattagtattatttgagtttaattgatattgattaattaattggttaaaagtatcattgctgactaaaagatttagtgagtagtgagtttcgtgaggagtttgcccaagtaaatactgattagtatatttaattttatttaaagtaatttcaatttcatcaccattgttattaaatgtagttccgattaagtgatcaagattttcttttaagatatcagtttgcttatacttccgatttaatttaatattattttctttgttgattagaatttgattttgaagttctttatttaaattagggatactatctaaatattcttgattataagtaactaaattaagatcaaggaaataagtatttccatagttttgttcattttctgttagaaatgataataattcaggattaatattatctaaactagtttctaaatttaatgatgtttctttagcaacagcaatttgagtcgtattttttagatgggctaattcgttaatcagttcttgattttgtgaattgatattaatatagccatcatagttgatattgattgaagtcatatcatatgattctttaagataataagtaaatccagaagcggttaaaaagaggatagaactaatgattaatgaaaatagggtgattcgataacggtttttattacgcttaatatttttcatcgctaaatcaccttcaaagccaaatattcggcgagtaaggaaacttgttttaatatttcgcaccttgattttagtatcttgttgattagtgattgctgcaatcggcgaaatcttactagcgtgataagctgggataatactggagataaaaattgtgataattgcgcaaataacagctgtcaagatacctttaaatgaaattgctaaaggaaatccgatttcttgtccaagattagctaagattggattgatgactttaaaggtaacagccattcctccaactcctgctatcacacctaatataatagcaataatgccaactactaagccttcaaaataaacagattgttttttttgtcgttttgttgctccgatacttgataaagttccaagataacgactgcgttcatttaaggaaattgcaaaagcattataaatcaaaccaatagaaccaatcatgataatgacaacaacaatgccaacggctgtcatcattgcttggttaaaaccatcattattactgattccgtaataataaagaagattttgatgataactaatatctccactgtctattcctaatgattgtgcggtatttgagccgttatcaaaaatatcattgtcgacatgattaagggttaaatacattttgctgcttataatgctactgctgttagcggtataaaaggaattataatacgatgcttgatcgaggtaagtagattgataaataccgacaactttaaatgttttgactggtagggcagcagtagattctagttgttcggtttcaataaatttatcagaaatttgtgttgctccagttttaacagtaatttcgtcaccgacctttacaccattttgagtttgataatactttgaaataatgatttcattactatttgctggatagtttcctttcagtagttttatttctttagagtaattgtctaattgatttagttcaatgaaaataggattgttttcatcaattaataaagtatcaattttttggaacaagacactattttgatatgcatcatcattttttaagctgtcgatctgttgtgaggtgaggttatcataagcaacatgccagcttccatcataactagatacctcaaggcgcatcatttccataaatgaggttacgaatgtagttactgcggtaaacattgcgactgatatgatgattccgacaatggttacaacggttctttttttgttggctaataattgttttagagtaagtttattaataatatgcatcttagccacctcgctttaaatcactgattattttgccatctttgatagtgattactcggttggcaagtttagcgatattattatcatgtgtaataataatgattgtttgatgatatttttcatttgcttcttttaaaagacgtatgatttcatcactgtttttactatctagattgccggttggctcgtcagcaagaactaatgaaggttgattaattaaagcccgagcgattgaaactctttgttgttgaccgccggatagttgattgggcaaatgattgagacgattgcttaagccaagttgttcgataagggtattaaatcgtttctgatcaactttttggtgtgctaactgcaagggaagggttatgttttctttaacatttaaaacgggaatcaaattataaaactgataaattaagccaatctcattacgcctaaaaatagctaaatcattttcgttgagtgtataaatatcagtattattaataattactttaccgctgcttggatgatcaacaccaccgatttgatgcaatagggtactttttccactgccactagcaccaataatagcgatgaattcacctatttcaacatcaaaagagacattatcaagggcaatgacatggttattttcatctccatatattttagacaaattttttacacttaatatattcatatatttctcctaactgtatcattgtttatagtacagttagataatagcacagagataactgtattacaatagataatacagtttaaattaaaaatatcactaacattattttgttagtgatatgtgagtcaagccgatagcgtgatcatttaaaattcctgcaatatatgtcaatagttgccgttgggctgttgtgtagacatcatagaatgaattaatatggaataatctaaatgagtctccttcataatttaacatccaatgaatagattcaataaaactgccatgaaattgtggtttttgaacaattggatgatagctggaagtattttcttcttgataaatacgatcgagcatattggcattatttttacaatcggcggaaaaattcaaaatacgtgttttagttggatcatcgggagcgattgttgcaatcagatcataatttgctgcagcaaaaagctgattataaattaaatttttaattacggtattatccattttatcacctgttttaatatatgcacaaaaataaaaaagataaccaatctgttacaattgattatcttgatatttatcacgtgttaattcaaaaagctcgaggtctaaaaattcaccacgtttgtaagcgtgtttttttaatgttgcgaggtattcgaaattatttgcaagcagaacttttctactgccgatattacgactgaaaatctctgctttaataatcttagtatcgtaattatcaaatatatatttaataatcatttttactgcttttttcattataccttgatgccaataaggctctccaagccaataaccaatttcagctaggtggctataaatgtcttcaccaaaagtaatagaaattgctcctgcgaataatccgtcgacaataatagcatattcgattaggttattattactgttttgagtaataaagtttaaataattttgagcgtcttgtggtgtataaggataaggaaaaatatcttttaggtttgcagaaacttgagggttgtttgccaaagcggctaaggcagattgatcacttagctggtaaggtcttaatcgtaaatccattatggtaaaggtttatcctctgcagtataaatagcataccattcttcacgagttaatttaacctcaactcctttaatagtatcaagcatattttttatactagttgttccggcaattggctgcatctgtgccgggtgacgcaagatccaggctgttacaattgctacctttgaaacgttatacttatcagcaagtttatctagctgttcgtttagtttaggatatttagggttatcaataaaagtatcttcgcttaatgaagatcgtatcgttgaccatggctgaatcgtaatgtcatttaatcggcagtagtttaaaatatcgccatcatggtcaattccttcatccatattggcatagataccgctatcgatcatttgagcgtgtgccggaccaaattgtaattgattaataatgattggctgtttacaatatttttttagtaactcgatctgaccgggattttggtttgaaacaccaaaatatcttacttttcctgcttgatataattcatcgaaagcttcactaacttcttgagggtccattagggcatctggacgatgtagtaataaaatatctaagtaatctgtctgcaatcttgataagatactatcgacacttgctaaaatatactctttagaaaaatcaaaacaaattccagggcgaatcccgcattttgattgaataatcatttcttttcttaattcaggatgtttttgtaatactttaccgaataattcttctgattttccaccaccataaatatcagcatgatcaaagaagttaataccagcttttaatgattctaataccaggttttcaacttcttcgggagtttttgatgcgatgcgcatgcaaccaagcgctacttttgaaacctttaaattggtttgtggtaaactataatattccattttatttcctccttatatagatacatttgattatatcatgattgtaaaaatcatggtatactatatccaaggttaggtgataatatgaatgtaaaattaaagattttttgtggctttttaagtggtgtaattataggatttatcttttcaccagttaaacacggtgtaaatgtcagagtttgtaataatggtaatcatgatcgaggtgaaggataatgtcatatcaagttattaaaatgattgtttatgtagtttcggtgatgctgtcaatgtggtctttaagttgttttaattttgataatgtaattcgtaaagcaaaggtaagagaattttatttattctttttaattgcttcattatgtttaggatatttattaggttcttttattttagaatttacaacgattcatttttaacatatttttaaatctcttccatataattatgtgaggtaattatatgaaagagataagtgttaaattgggagtcgtttttttaattgcagtaatctttttatcaattaatgttggggtaaaaaaagatgaaacaatcaaaggtacagagactaaagaaaaaaaagaagaaaaagaggaaaaagcagttcaagtagcagtaacaattgataataacgttaattatatcgatttagatgattatcttttaggagtcgttgcaggagaaatgccggcaaaatttgaaacagaagcattaaaagcgcaagttgtcgcgagtcggacttttgtttacaatcgcaatttaagcgttgataatactactaatagtcaagtttatttgactgaggataaaatgcgggaaaactggggtgataagtatgatgagtatcatcaaaaaattgttgcggctatcaatgatactaacgatgaagtaatgaaatatgagggaaaatatattacggcaatgtttttttcttcaagtaatggctatactgaaaatgtagaagattattttgattcgagtgctttgccttatttgcgaagtgttgactgtcattgggatttatcgattgatccaactaatagtcggtcaaaaacttttactaaacaagaactaaaagaaaaatttaattgtgatagcttagactttaatattattgcgtataaaaaaagtggacgtgttggaacccttagtgttggtggaaaaaattatagcggacgcaaagttcgcgagatccttggattagcttcaagttgttttacgatcaaatatgaaaatggtaaatatacatttaatacgctcggtagcggtcatggagttgggatgagtcaatacggtgctcagggaatggctcttgagggagctagttataaagaaattttaaatcatttttatacaaatgttgaaattgtaaataattagtataaacctgattttagtggaaacactacaaatgaggtgaaacaatgaaactatttatgaaaagaaatcgacgggttttagtctttacaacggtagtgatgttatttttagtcggagtaggggtaattcagttagtcgtaaatcaatatcgtccgcttaaagacactgcggttgtaaaagtggaagataataaagataaagatactgacaaagaggatccccaagcaccagcagaaaaaatggtaaagccggttggtgatgacattaaaatcgtaaaaaaattttatgattcaagtttaagtgatgaagaattagaaaaagcattagtttattttgaaggtgtttatcgccctaatctaggtattgatttttcaaaagacaataaagcttttgaagtaactgcggccttttcgggaacagtaactaagaaagataatgatgcactgttaggttggattgtaacggtaactaacgaaactggtgtctctgcaacttaccaatctttaagtgaagtaaatgttgaaaaagatgcggtgattaaacagggtgataagattggaactagtggtgaaaacgtctatgaatctgaattaaagaaccacttacactttattttagagaaggacaatcaagcattaaaccccgaaaaatattttaatcaagaggtctcaaaaatagcggtataatcaaccaaatagtgataattaaaaaaattatcgctatttggttttttgccttgtaaatatctaaattcatggtacaatagttaagaaaaaataaggaggacgaatgatggcattatcaaaagaaattggtatcgatttaggtactgcaaatattttaatttatgtcaaaggtgaaggtattgttgtaaatgaaccttctgtagtagcgatagatgatgaaacaaaaaaacctttagctgtgggtcaagaagctaaagatatgttaggaaaaacaccaggaagagtaaaagcaatccgtccattaaaagatggagttattgctgattttagaattactgaaatcttaattactcattttattaataaattaaacttgaaagggattttttcaagaccaacgatcttaatttgttgtccatcaaatattacatcaattgaaaaaagtgcaatcaaagatgtggctgaaagatgtggggctaaacgtgtttttattgaagaagaaccaaaagtagctgcagttggagcagggcttgaaatctctaaaccaacaggaaatatggtaatcgatatcggtgggggaactactgacatcgcagtattatcattaggtgatattgttactagcagttctttaaaagttgctggtgatgtaatggatgaagatattattaaatttgttaaagataaatataagttattgattggtgatcgcactgctgaacaaatcaaaatggaaattggaattgcaatcaaaggaatcagcgaagaaacatttgaagttagaggacgtgacttagttacaggattacctcatacaatcactcttacagctgatgaaacagaattagcattacgtgaaacttgccaaacaatcgttagagaaactaagcatgtcttagaacaaacacctccagaattagctgctgatattatgtcacgtggtatcttcttaacaggtggaggcgctttattaacaggattagatcatttattagaaaatgagcttggggtaccagtatttgtagctgatgacgctttaaactgtgtagcaaatggttgtggtgtcatgttagaaaatactcactatgtaaaataattttaaggatatggaaacatatcctttttttgtactgaaaagtcatttcaagaaatacgtttcatagatatgaaatgctgaaacgcagtacctaaatgactttggaagattgttttaagtttatttcttgttaaaatttgaatatagaaataaatggagggaagagcaatggtacatagagttaaacagattagtatagtggtattaagtatgttggttttgttgagtactttgatcgttgggacttatgcaaaagcaactaatttggtatcaaatggtgattttagtcaaggaactaattattggagtatgaatcaaagtgatggttcgttagcaatgatgtcgagtgataatcattctttaaaggtacagattgaaaaggtcaatagtgatgactattggtggtccttaacactcaagcaggataatattgccttatcagcaaataaaaaatatcagttatcatttgacgtagaggcatcaatgagtggagatattagtttggatattgaaagcacaagcgattataataaaaaatacttagatcgtcaaatgatagcggttagtaatcaaaagaaaacatatacatttgattttgaaaagaaagacgatgatgctgtcactttagtttatcatcttgctaaaggcgatggaatcagtgattttagtaatcaaataatcaagctttctaatgttacaattattgaaattggcgatattgaaatccaaaaagcaggtgattggtatttaaatgaaggagatggaattagtaatttcaaggatgagactattaatattagaaatgttcgtatagaggaagttaatgatttaggtgatgaatatgttgtaaatggtgattttgagacaaatacaacaagtggctggaatacgtataacagtaatggttcaaatttgaagatcaatgcagtaaatcaacaattagaagtaacttttccaaactcaaatggcagtaactattgggattgtcaattgtttcaaggagatattcttttagataatggaatctatcgtttatcttatgatttaaaaggcagtaaagctgggactatttactttgatgttgaggatactggtgattacgcaacaaaatattacccagaaacaatggttgatttcacaaaagatgttcaaacatataattttgagtttgagattaatgctgataatttattagggactcaaaaaaatgctaagatccagtttaatttaggtcccaatgaacattgtgacagcttggctggagaaactttatattttgataatatcaagatagagaaaattggttctggtgcaggaactggtgaattacaaacgactaatgtgacttttgatggaaatgatgttttagttaataattttaaaggtttaggtgttcaatgggatccttatgttgttcaccctttaactgatgaagagtggcaaacagtgactaagcgggtagatttcttaaatccagcttttgttagatgcatgatctacgctaatacatattgcgaaggttttgatgatgagggaaatcctatttatgattttgatagtttggcaaatcaggcattgattagagaattagattatttagaaagtagagatattgaagtagttttaggtgaatgggagacaccaggtcgttttggtggtgaattcgaaggaattactgttgatgatccacgctgggcaagcattattggcggatttttagattatttaattaaccaaaaaggttatacatgtattaaatattttaactatgtaaatgaagctaatagtgattggtcatattgcggtgattttgataaatggcaaacaggaattaattatcttcatactgaattagataaatatggattaaatgaaaaaataaaaattacgggacctgatactgtatgggatagtgataatacttggttaaaagagattaattcaaatcaagatttagatgctaaaatagggctatatgatactcatatgtatccaacaattgatgaaattacaaatggtactattgaagaaatggtagcggaacaacgcagttgtgtgacgggaaaagacttttatatgactgaaatcggaatggttactggcaaaagtgatggggattcacaaccatatactaaagaatttagttatggagttattatggctgatgccgcaagtcaagttatgcgtggtggtttttctggtttagcaatttgggatttagatgatgctatgcatgatcagcaaaatggatttcccattacagatattcgttctttaaaacagtggggattttggaattctgttgctggacgagtttttaatcaaccagaagaagaagagatacgaccattcttttatacttggtcattaatggcaaatctattcccacgtaatagcaagatcattggttcaacagcaaataaagaattaaatggtcttcgaacagttgggatggaaaaagatggtcaaatgacatatatgattgtcaacgattcaaacagtcccaaagaagtaaccattgatgttaaaaatcttaatgctaataacttaaaattattcaaatatgactattttgataatgatcgtaaggtcgatagtaatggttatccggtcgctagtaaggtacttgaaaatgtcaatcttgaagaaggatatgaagtttctttaccatctggtggtgtggtgatgctctcaactattgatattgaagatgctaaaaaggaattagttgatcaaaacgattctaaacaagataatgaaaacaaaaatgaggtagcaatcaagacaggtgatgatttaaaggctgctggatttatgatttctggattacttgctacggcatttatctatggcatgaagaaaaaaggatagtagtgataagcaaaccaaatttggtttgctttcatttttatgaaatgctatttcattttaagtgaattaaaaatattatattttgaaaagctattccaattgtttatgtaagggtttacattattgattgattgattaaaaataagattatggagagcaaataaaaaggatatggaggaaaggtaatatgaagggaatgcataaacatgcgatagctttattgttgagtgcatcattgctgcagtctaacgtaatgcccctatgggccaatactgcaccgtcagttcgggaaacaaatcaagtagacgaactagatgatttttctaaagtcttaaatcatagtgacgggtggcaaacagtcattgatgagccaaataatttttttggtgattcaagtcgcttgattaggacagaagatagtgcgcaatatttggtttatcaattagataatctaacagattttaaagttagaatgcatagttatttaagaaatctgcgttatctcgtaaatatttatcagtctaatgacttaagcagctgggaagcagtagactatactattaccagcgctaaaactagtgattcagctttttggggtacatttgatcttatgcctaagaatattttagatgggaagaacaaatatttaaaaatagaaataaagaataatgaaaatgctgatcaaacaaaaacagtaaaaggcagtgatgaagttaattttcttaaagctgttcaaattggtaaagtagagttgacggatagtaaagctggattaattactaatacaaatactgatttaaaagcaattaagttagaaggatttgatgatagcaagacttctacattaaaaatatcagaaaataaaacaataaaattaattaatccaacaatttatgatgtaaagattgaaagtagtaatcctaaagtcgtaaaatatgaaaataatcagattattggtgttagtaatggaactgcttatttgaaagggatagtacccggggagcttgaagtatttaggtatgaaataaagattggaactggtgaaaatttggatatttcacctaagtatactaaaccagctgatgatacaggtgatagccgttatattaaacaaggaaatggtgaagaaacagataatcttattactgttgatcctgataatattattgtaaaagattatatgggtggagccatggaacttgagatgattgaatggtttgatatggatgatgctcgttgggaacgttattttcaaagaattcaatatatggagttaggctttgtcagatgtatgttagcagcttattggtattgtacaggatttgatgatcataataatcctatttatgtttgggattgtttgaacgaagatggtagtccaaaatattattctcgtgatggttatccaattgacccattaggaaataacattgaaccgaatatcaaaaggatgaaacgtttatatcaattgtttgatttctttaaaaagaataatattactgtaatgacaggtgaatggcaatatcctgaagcagcagaatggtattatgtgccaggtgaaaatttaaaacaatataatttaactttagatgatccccgttatgctcaaattgcagcggattttattgaacatatggtaaaggataaaaattatacttgtattgaacaatatgatttaggtaatgaggtaaatataaatcctggatcatatcagtatgataaatggaaacaagcaaatttaaatctttatgatcagttaaagcaaagaggtttagaaaagacaatttcgttgacaccggacctaagttactggttagatttatggtataaccaaagtattgctgatcttcatgatgttttcgaacagtatgaattccattggtatgtaaatgaagttaatttaaaaaatggagtttttgaaaatgaaatgcggatgttagttaataatgccgctggtcaggataatcctgataaaaaggtctatatgggtgaagtcggaatgcgcgattatttgaataatgttgatcaagtaacaaatatagacagctttgaatatggattatggatggctaatattcttgtacaaggaacaagggcgggaatgtctggattaacagcctggtcactagatgattctgtgcatattaatggtccaatgacttatgattattcagtagatcaaaaatcattgatgaaagtctggggactatggaattcactaggtgaatatcagggagtatcggaggatatacgaccatggtatgtaccttgggcattagcaagtaaatttatgcctaaagggtcacaaataatttacactagtccaactgaacagcaagtgtattcaacggctgccatcaatggagatgatttaacaatatccgtagtaaatcattcaggtaaagaacagcaagtgttggtaaaaattcctgaggcgactaaaaaagtggatttaagtgtttatgcttattttaaagatgatttaaatcaagatgaaaacggatatcctgttcgttctgattttaaaaagaatcttgatttgcaggaaggaattgttttaactttaccagctgatggtaatctggttttaactactatggagggtgaaaataagttcaatagtaaggatagcggatattttagtgactcaatgcagtcattacaaaatacggttgattatcaaaatattggctttaactcatatgaaaaacatcctaataatgctcaaaatcgaattaatatgaatcaggatatttttggggatgtgacaaggattaatcgtgccggcaaagataaagcttctttggtatatcaaagggctgaaggaattaaaaattttagaattcatagttatgttaaaggagcagttggaagtaattttaaagtttatggttcgaatgataaaaatgaatggacagaaataaaaataaatgaaatagagaagtattcactaactaagggatggaaatttgcagtattaactccagagtcagaaatcgaatataaatatataaaaattgagttaggaaacgaggtatcaagtacagatattcaagttggaaaagtagagttaacgaatcaaagtgaattcagtgaaccgctcaaattagaaatacctgatgatgctcaaagtagtgaatataaagaaattatgaaagatgttcaacttgctacaaatgatataatgagcatttattcaataagcggctttgaaaatttacctgaaaattgtacgttaaagagcagtgatgaaaatattgttaaaattactgatatgtcatttaaggcagttaattcaggtagtgctttagttaatgtttatagagatggaaaaataattggaagtatcattgtcaatgtatatgctttccatgattctgttgaagatggtaatggattagtatatcagcttaataatatgaagtatgatttaatggcagatgctaatgatacaacattttcacgaactaatgatggaggaaatgtaatttataagttagcgggtattaaggatttttcaattagaggatatgtggcagatagtaatgataaattgtttgaacaaattaaaatttacgcttccaaagatggaaatacttgggaaagtatagaaatcaaagtagacggtataaatgctttaagcaatccatattggcattatgcaaatattattcctcaagaagcaattactaaggattatgattatttaaagattgctattgaaggaacattaacagatcattggaagattcaagttggcgatgtacgtattcaagacaaaccatttaattctgttgttaataaaattgaattagcaaatcaagatttgaaattagcagttggaaatagccaaataattggggctaaggtttatccagaagcagtattcccatttaaagttatttttgatgctgctgataatgagattgtttctgttgataaagatggtttagtaactgggcttaaagctggtaaaacaacagttcgtgtttattctcaggataatccagaaatttatcaagactgtacgattgaagttacagaagtgattgacagttcaaaggaaattgcagatagtattaaggagttaacgattattaataatcaaatcgttttaccggttgttgaaggttatgaaattacaattaaaagctcaagtatccctaatatcatcgatttagatggtaaagtaacaccaagtaatcaggatgaacaagtagcattggtcttagcagtaaagaataaggctacgaatgtagtatctgataccgcaaatattattgtaactgttgctaaaaaagatgaaacagttatgattgaatttgatattactgatgttgttttaaaagtttatcaagaatttgatccactagcagatattaaagtatttgaaaatgatacagatattacaaagaatgtacggatcataagtaataatgttgatttaaaccatcatggtaaatattttgtcacatatgaagtaactgatagtaaaaatattacgcatagccatactcgcaatgttgaggttagaggaattaaatcaatcagttgtccagagtatcaagttgatcttactagtttgaaggacctggacccagatgtatttttaaatattgttaaagtagataaacaagttattttagataagctcaatagcaaattaattgatgaccaaataattattagctgttatgatttggcaatgatgttaaataacaaagaatatgtactgaccgataatcaattaacgattgtatggaatgttacatcaaagatgcagggattcaaagttctgatgctagataaggatggaaatgtagttgaggttccaatgactgttaatggtaaggaaattacttttatggttgaacagttaggtacttttgcaatagttggtgaacaaaaagtagaaacaaaagaacctgatgaaaataagccagaaaataaggttgaaacagcagttaaaactggtgatgaagtttattatgcggaatatgctgtgttaggattattggcactatcattagtttatggaatgaaaaaaagaggataaaacaaaacccaagcttattgaaaaaaagtaagcttgggttattttatttgtttaatatgtcgatggtcgataatatgatcggtttcaagttttaattctagattttcatcatagtgtcgagcaaataggcagctatagataatatcaagcatgatatggatggaaatcgttgaaccaaaagtagaaacttttgaataaattcgttctcgagaatctaagaataaaacatagtcacatagttttgaaaggcggctttctccaaatgaagtaattgcaatcatcggaaccttacggcgtttcaatagttctgcggcagcgattacttcgttagtttcaccagaatatgaaattaaaatggcacaatgatccttatttgattgggcagcttgaaatagttgttcattgaccattggtgcaatctgaacattttttccgattcgaaacatcttatattgaaaatcagaggcaattctaagtggacctgatacaccataaatatcaataactttagtttgatcgagcataataatgatttttgctaagatatcattgtcaatattatttacagtaaggttgattgaatctttagctagtgttgcaatgctgtgtttgattgtatggatcgtatctctttttttaaaaggaaaattcggatttgtttcactatttctatcaaacgtatattgtaactgagctgataatgcaattttaaaatcattatatcctttatactctaatttttgacatagtctagttattgtagcgggcgaagtatacgttgctttagctaactgagaagtagacatatttaaaacatcgggtccattttttaaaatatatgttgcgattaatttttcggaagttgagaagtcaacggccatttctagttttcttagtagactcatttttatcaccaattttagtataccatttttttattattaagtttaattatttagttagataaatcaaaaaattgctttttttcataaatatgaaatgcttttttaatcaaaattgaatttaataatcacaatttttaatatttaattttttggataagcgaagaattatatattgcaaaacttcttgtttcgtgtttatgaaatatcatttcataaattgcccaataaaataataaaagtttgaaaggagattgcaactatttgtgtaagtgtttacaatcattgtttagacaattaaactaaaagtataaatagagattagtaaggaggagaaaaatttaattaatttatgagggaaaaatataaaggagaaaggaatactatgaataggaaatttaagcgatttttgacttcattattatcattagcggtagttgctagttctggaattggaccagtaaaagccgttgataatacccctaaactggattcaaaagtttatattaacagtgataatgtattaactaaagattttgaaggatttggggtacaatgggatcctagtgatttatttgattacactgatgaacaatggtcatctttttatgaaaaagcaagctttttaagccctaatgtgatgcgggtcatgctccatgatggggacagttattgtattggctttgaagacgatggaactccgatttatgattgggagtctgttatgatgaagcgtgtttataaaattttagattttgctcaacaaaatgatattccaatcatgttaggtgaatggagaagtattagtgaaagaggatatttatcttacgatgatcatggaaaaacggtaaattggagtagtcctacatgggcaaggatgattggtgattgtttagagcatttgattgttgataaaggttatacttgtattaaatactataacatgattaatgaaccaaattattataaacgagatcatggtgatgtcacaaatgaatatgtatatgatcaatggaagcaggcaattactaatttaagaaatgaaatggacagttctggtatagaaaaaattgaaaatatcaaaattgtagggccggatgtttatgattcacaagaagcttggataaatcaagcaacaagtgatgagatgaaagataaaatagaattaacagaagtgcatagatatgccccacaaagtgaggtagaaagtggacttattgaaaagaaattaaagacttggaaagaacaggctgaaagtcttgatcctgaagttgctgaggaaggatttgctttgggtgaaatgggaatttcaggaactggtcctggagattcgcaattgaatgcgagaaaatacgattatggagtggatatttttgattatggtgtccaagctattcgtgcgggattaaaatttggtagcgtatggggctttgaagatagtatgcatgttcagcataatgatattgttaataatttcaaagatcaatatggacctgctgcaacaacagaagaaggtagagattatgttgtccatacgccaacaggagatccttcaattgataatgatatcaagatatggggattttggaatgaacttggtgaagaaatggcagctcaaaatgctgagcataatgttacgggaagagctaatacagtaaaagcaagtgatgagaatctaaaaccatggtattatacttggtcaatgttatgccgttattttccatctggaacaaagattcttgaaactacagacagttatgttgatcagttaagagttacatcaggaattattccagttgcagatgataaaggtgatattagtattgcagttgttaataattcatcatctcaaaaaacattagaagtaaatatgcctaatgcagctagtaaagttgatcttaatcaatatttctattatgatggtgaaattgatgggaaaactagaccggtcaatgaaaagggtcaattgttacaatatggcacaattgaaaatgctaatcttaaggatggtgttaatgtcactttaccagcaaaatcatgtatgatcttaacttctttaggatatgagggtgaaagtcatccaatgagttttacaactggtcaaacaactgatgttgaaaaggttgaaatttatgaaactactaatgctaaccaattagaagttggtaagtcttatcaattagcagctaattatattccatctatttcaaaaggtgaaatggaatggtcagttgttgattattttggtaatgctagtgataaagcattaattgatgaaaatggacttttaacagtaaaaaaagctggtcaatttaaagtgattggtaatttaaaaggaaaaccagaaatacaggatacattagtatttaaggcaacaagttctagtattttagttgatgagttaaatgaccttgaaaatggagttgctttatcttatcaagatattataaaagatgataattcagctaattttaatggtgataaaacagttaaaagaagtgatagtaatgcaaatggtaaaccaggaattattacatatcaagcaaataacatttatgattttgaatttagtgcatattcattaaataataatcttgataaatctggaaattttgtagtagaagtttctcaaaatggtgatagctggtcaccagttgaatgtgagtttattcaaggaagtaaattaagttctggctggtatccatatacaattaaaaataaagcggtaataaaagatgatggatatcaatatttacgggtaacgatcacaagtaagtcaggttataaaacatatgatcctcaatatgctggtggatcaatatattatgattaccagggagcatcacaaatcgatattcaaagtcataatgaatttattgttaaaggacaagaattacagtttaaagcagaagtacttccaagtattgccagccaagaagtaagctggaaagtattatctcttgagggaaaaccaactgaacttgcaacaataagtccagatgggatattgactgctaaggctaaaggagaagttgtcgttgtagcaactgctaaagatactgatgttagtgcttatagtcatattaatattattaatggttattttgtagatgaaattgaagattttagtaaaatgtatcaatatggtgaatttgcttttgatgatcctaaatcatcaaatttcactgataaaacaaggattaaaagattatcagatagtaatcaaagtattgtttatgctttaagtgatattgaaaaagctacttttgaaatctataaaaatggttcatttgtaaatgattcagtagatatttatgtttctagtgacggattaacttataataaagtagagaaaaatgttgtaaatgcaggtaaagcagctagttcaactgaatattatttatatgaagtatcgactaaagagttaggtgataatgtaaattatattaagttagaattgaaaaatgatgaaataatttattgtccaatgttaggaaaaacaaagattatttataatccaattgaaaatgttgaagtaacaaatgttactttagatcaaaaagagttatctattaatgtaggacaaagcaaaactttagttaaaaaattagcaccattatatgcagacgagcaattaacttggtcaagccgtgacgaagatattgcaagtgtagatcaaaatggtatcgttactgctaaaaaggtagggagtacaattatctatgcaaaatataatgatgaaatttatgctacgagtgtgattaatgttcttggtgaaaatatggcattaaataaagatgttagtgcttcaacagaaacaaatcaatggaataaaaatccaacaggtaaactggttaatgatggtgattatgatacacgctgggtttctaaagatgggacatcaatcactaaagaacaaattacaattgatttaggtgaagtgacaactgttgataatgttaaactttattgggaatcagcaagagcaacagattttaatattgaagtgtctactgatggttcaaaatatgatatagttgaaaaattacgtgatgaggataaaaataaattaactaatgagatttcatttgatccggttgaagcaagatatgtaagaatgcagggattaacaccagcaactaagtatggttattcaatctatgaatttgaaatttataataattcagatttaaaattagcaagtagtgttgaatttaaagaaatgtcatcagaactgtatcttggtgaaaatacagcacttgatgtagttgtaactcctgatgatgcaacatatcaggatgcttcatatacttcaagcaatgggttcgttgttgtttgtaaaaacaatcagatgattgctgttggtgaaggaacagcaacaattactgccaatgtcaacggtcaaaaaataactaaagaaattactgttgttaaagataatgcccgtaagattgctcaggagctgacatcattaactgttgaaaatggtcgtgtggacttcccgacagttgacggctacagcttcagtgtattcagttctgatctggaaaaagttattgccaaagacggaagtgttaacttaccggttgaagatcaagaagtggcacttattgtaactgtatctaaagacggcagtgaagacagtgcaaatactgatgaaatcaaagtgacggttaaaggtagcagagataaatatgagctgttggaaaaacgaatcaaagaaatcgaagaaacagactggacagtatataaaccaggtacagttaaaacatttaaagagaaattgcaggcagtcaaggaaagtctaaatgcagaagtactgttagtcagtgaagttgaaaaagcaggagaaaatcttgaagcagcatttaagggattagagatcaaaagtgataaaaagacacttgatgcgctgattaaagaactagaagaacttgataccaaagtatataccgaagtatcagtggcaagagtggaaaaagcattagaaaaagcagagacagtcagtgaaaacgaagatgccagtgaagcagaagtaaatgatgcagttcaagcactgtatgaggcaaaattgggattagtggaacagatcaattatgacaatctaaaagatcggattgaagaaatagaaaaagaagatctgagcatatacagtgaagcgaccgcagctcgcttaaaagaacagatagcagaggcaaaagaagcattaaagaatgaaaatattacgaatgaagagttgcaagaagaactggcaggacttaatgaaaaatacagcagcttaaaactgaatcatgagccgggaagtgtagaagaattaataaaacgaattgaagagatggatctgagcggatacagtgaagcaagtgtaaaggaattagaaagagtaataaaagagatcaaagaagagctgttagaaggggtagaccaagtaagatatgcaaaactggcagaaaaactacagacagcatacgaaggattagaaaggaagagtgaagtaaaactggtagaaccagaacaactggaaactccaaaaggagatgaacaggcagctaaaactggtgataacatgataattggaacatggttaatcacaatgtcagcagccgtaatggtagttatattcctaaataaaagaaggagtttagaaaaataaaaatggggttaaatagagaaagtagttcttaaccacttatagatggaggagtaatatggggttattaaagaaaattgaattggcaaataacttttcatcagtagaacggatcttaggtaaatacgttttagaaaatggtgaaaaagtattaaacatgtcaactaaagaattagccaaagcaacatttacttctccagctagtattgttcgtttttgtcgaaaacttgaatatgaaggatataatgattttaaaattgcattagcagctcaattacaatatagtcgtcttagcaatgatgatattaatgcaaactacccttttaaaggaactgatagtgtttatactgtggctagcaatattgctaatctatcaaaagaaagcattgatattacaatgaaaaatttagatttagaagaattaaggctagttgttttgatgattactaaagcgaaggtcattgatatttatggggtttcaggtccacttagaattgcaagtgactttcagtataagatgtttagaataggtaaagatgtgcggatttcacaaatgatcaatgaacagttgtttcaagctgctcaaagtacttcagaacatttggctattttaatttcttattccggagaaacagaagaagtaattgaagcagcgaagattttatatcgacgtaagattcctgcaattgcaataacttcatttggagaaaatcgtcttgtaaaatatacccaaagagtcttatatttaaattcatcagaatttatttattctaaaatcgcaactttttcttcgactctctcactacatttattgttagatattatttatggttgtgtattttctaaaaattatgaggataatttaaattataagattgaaaccgataatctaattgatcatcgtcaatcaagcattgcaatagataaatttaaataattattaaaacgatatggaagtttattttaaccatatcgttttttatttatgaaaccatatttcataaataaatataataaaaagtaaaagtctgggataccaaatcaaagattaataagattatcataacggagtgattaaattgagatgggaaagagcagtaaagcttgtatttattgtgtgcttaataatttcttcgctatctacaacaagagttaaggagttcgaaaattctaaaaccttggtagataactttgatactgaagcaccatcagcttagatttattatggaaatttatctttagttgatagttttatagatatttttcctacttggatttcaacaacgctggttcctaaaaataatggttcaataataagttcaggtcaaaaaaatggatacgcaatttatcaagttgataatccaagtaagattacatatatttcattgaactggaatggttctggagcagttgggaaaatcggggttaatcaaatgcgccttagaaccggtgcaagagctgaccaagaagtgtatttgccattttttgatttcgaaaatgatatagtatgtgcaaaactggcagaaaaactacagacagcatacgaaggattaaaaaagaagagtaaagtaacactggtagaaccagaacagccgaaaactccaaaaggaaatgaacaggcagctaaaactggtgataacatgataattggaacatgactaatcggtatggttgtaactttagggggaatagagtatatcagaagaaaaaaggcgagatgatgtactgatagagtataattagatttagataataatttcaatcaaaagaaagtgacgatttggttaagttttgcttaactataatcgtcttttttatggttttagttaagttgataaagtgtttgtaaacttcgttgacgctaaaatctcagtgtgtaaaataggtggcgtagtacagatttataacttaaaaaaaggggactatgacatgaatgagaatttgaaaaaacgtattattgtttctttggcaacagtatcagccttttctagtttggcaatggtaccattatctgcttatggtgaatatcaaggtaatgatggaacacaaaaactaaataatgggctgactagtactagtgattataatgattggtataataaccaatggaataatcaagaatccggtgaaatggatactggaaaaattgtattgacaccgggagcaaaagcaactgatctaaattttgcctggtactcagaagaaacgggaacaccaacagtaaaaatttctaccaatcaagatatgtcaggagcaaaaactgtaacgggcagtgctgacaagattaacaagaacaatagtttcaaaaactatactgctagtaataaggtagcacttaaagattatctagtggaaaatatgacttactattaccaatatagtacaaacggtgttgattggagtgatacatatacttacaaaacacacagttttagtgattatcaggcagtattagtaggagatccacaaattggagcttctggaagtaacggacaaggtactcaagatgatactgatattgcagttaatacctatgcatggaataagacattgcaaaaagcattaggagctggaggcattgcagaaaatgctagcttcattttatcagcaggagatcaaattgattattcatcaagcggaactaatggttctggagagattataagagaacaagaatatgcaggtttcttatatcctgatgtgttgagaagtacaccattagcaacaacgattggtaatcatgagtcaatggtcgatgattacagtcttcattataataatcctaatgcaagtacattaggttctacagaatctggtggagattattattatagctatggagatactctatttattagtttaaatagtaatagtcgtaatgttgaagaacatcgtcagttaatgaaagaagctgtagctagtcatgaagatgcaaagtggaaagtggttttattccatcatgatatctatggttctggttcaccgcactcagatgttgatggggctaacttaagaattttatttgcgccattaatggatgaatttaacattgatttatgtttaacaggtcacgatcattcttacgctcgtacttatcaaattctagatggaaaggtaattgaaaccgacggtgttagtgaaaatgctagtaaagcatataatccagaaggaacattatatattgccgcaggatctgcttcaggaagtaaattttacacattgaatacagttaaacaatattatattgctgaacgttctaatacaccagaaccaaccttttcaacaattgattttagtggagattctttaacaattaaaacttatgattacaatggtcaaaaatatgcaaatgatgtaactttatcaaaagatggtaatgctaaatcaattgaagaaatgaagaatgaagtagctgcgattgatacagtcaatgtaacaagtggctctaaaaatagaatcgatgaagctttaatagctgtaaatactgctttagacacacgtgatgatagtacagctgaaacagaattacaaaataaatggaatactacaagtgatccattaaattattacggttatgcccaaaatggttttgcaaatgaaaatagtactgccttaaaacgagggtattcatctttattagacaaaacgttatatgaaaatgatagtaataaagctgttacaactgcaactatcgatgaagcatataataaattagcaacagctaaaaacgaagtcgtgacaaaagctgagtttgctgaagtacagactaaatttgatcaaattggaagtactttagcacaaattagtatcggagataaaaaagatcagtatactagagcagatgtagatgctttcaagaaatcaattgcagctttaaaagttgacttcaatgaagcaactattactaagactgcattaaatgaattgagtacacaattagatacagtgacaaatgaatttttagcaaagaaaaatactgaggatattacaacagctccaattgttactccttcaacaacgccaagtaaaacaccagtaaaaacaactagcagcaaagtaaaaactggtgatgatacgtcaatcaatttagcaggtattactgctttcgtatcattgctaggaattgctggaacaaaattatttaaaaaaagaaaaattgaagaatagtcaagataaataatgaaataaacaagacagagcttgttctgtcttgttttatatatgggagaagttatgaaagagttattaaaagaatttaaacagttaagtaaaaaagaaaaaataggtcattttggagtctggctggcaattttagcatttttaatttttttatatttttttaataatgctgttgaaaaaacaccattgatggatcaagaaggtgctgtatttgaaaaagcccgagtgactgaaattatatctgaaaatcgtacagaaaatggacttcagcaaggaacgcaaatagtgaatacggagattttgtcaggtgattataaaggtcaaatagtagagactacgaatattgatagttatttgtacggtgctgattgtaaggtgggaactagggtgatagtgcagcttagtgaatataatggaaccttaagtgctagtgtttataattatgatcgcactaatacactatatacaatggtcgcaatttttttgattttattagttgtaatcggtaaacgaaaaggttttacctcagctttaggattaatttttacatttatttgtattatctttttatatctgccgatgttgtatttaggtttttcaccgttttttagtgcagttgctgtagttgttttaacgactcttgtaacaatgtattttataggtggcttttcaatgaaaactttatgttcggtactaggaacgattgcgggggtcgttgtagcaggaatctttgcaagcagttttggggcacttgggcatgttagcggctataatgttaatgatattgaaacgttactttatattggacaaaacagtaaattagatattagtggtcttttattttcaggtattttaattgcttcgcttggagcagtaatggatgtagctatgtcaatttcaactacgattgaggaaattaaatatcacaatcctagtatctcacgtaaagatttatttaaaagtggtattaaaataggtggagacatgatgggaacgatgtcaaatactttaattttagcttttacaggtggctctttaagtacattagttgttttttatgcttatgatatgccgtttttacaaatgttcaattcctatgatatgggaattgagatcattcaaggtattgcagggtcattgggagtcattctaacagttccatttgtttcgataattgctgcgattttaatgacaaaaaagaaaaaaggagattttccaaaatagtaaaaagccgctagttatctggcggttttgctataataaaaaaatgaggtggatatatgacaaaagtactattttttgatattgatggaacattaacagatacgcatgggggattgccagaaattccagccggagcccaacgaaaaatgaaggaattacaagaacgaggttatttgttatttttagcaagtggtcgtccttatgcttttattccagagattttaacaaactttggatttgatggtgctgttttgtgtaacggagcacatgtggaaatgaatggacaatttatttatcatcagcctacagatttaaaaaagacgattgatttagtaaatcatctggatgaaaataattttgaatatattattgaaacaaaacgtggagcatatttagatccgagttttaaagttttagaaaagtttttcataagttgtaatattaatgaagaatttttaattgaagactttaatagagaagatataattacagaatgcttaaaattagaggttagtgtacccgatgagcatcaagcaaagattgaagaaattatcttaaatgattttaactatgataaacatggaacagataatgcttttgaaatctattctaatgttatttcaaaagctactggggtacaaaaagtccttgaatatttaaatttgaatgttcaagatagttatgcttttggcgacggtttaaatgatttagagatgattcaaacagttggaacaggagttgcaatgggaaatgctgttgatgaattaaaagctgttagcgatttggtttgtgattcggttcataataatggacttgaaaaagttttaaatgatttatttggataaaaaaaccaagaatttcaaatgaaattctcggttttattttttactatttttttaaaacgaagtgatgaccaggtgttacaaaatctaataatatcatttcttcttctttaactgttgctactaaattacgttcaccatcatttggaatttctgttaaaacaatttccaattcaccacgataatgagctaagttatcattaacaatcaagacatcaccacgtgtgaacacttttttaccacaatcatgatgagggattgatttactgcctgcgatttctgtatttgaagtaaatccagaatcttgaactgtagctttttctttaaatttaactcttggcattgaagaacgtaacatgaatgatgagtgatcataacgatcccaatgaggggcaaaatcatacatgatcaatttttcattgtcagtaatttcaggtacttcatcaacacgaatttcaattgcttgataattaatttttgataaagcttctaactcttcatcagtagccggatagtttccgattaagatatcgtcaacgtcaccagttgctaataatgtacgagcttgtaagtcgattggtaaacctctcatgatttcgactgtaggtaaaccacagaatacttcccatggtccaattgtattagcgttgttgctagaaacaaaagcagctgtatgtaagtttaattctttccaataacggttatattccatgaatagattgaaatctaatcctgaataacgttcagggaagaagttgtggcacatgatcatttgatctttatttccaccatgattaattagtaattcaacacccatgtccatgctggcattgaattcaattttaataccatatggattacgtgtgatctggatatcaccttgtgtcccaaagtttccgtctaaacggatgatgtctaatcctaaatcagcaaatggttttaaatttcctggtgtagctccaataattttaaatacttcagggttagtatcagctgctacttcgaaccctagttcatgagccttatccatgaattctttaaattctactaaataactttcgcgcttatcttcagggattgataagaaacaagtaaagattctactaaaccctaatttagcggctttttccatataagcgtatacctcttcttttggtgatttatcagggtatactgatattcctaatttatgcatttcgttttcctccttaacaccattattataaaactatttattggttttgtcttgtattttatgcaaaaataattgataatatacaaaagataggaagtgaaaagatgaatcctagtttgattatgtcatttgttgtaactatgatcgtttcagccattctaattccgctagttatgaaggcgggtaaagaattaggaatcgtagcacacaaaaataagcgaacagttcataaggtcgaagtacctcgaatcggtggatatgcaatttacatcagttccttaattggggcggtcatctttttaaagactgatcctcaaatcaatgcaattctaattgctggtttcttggtattctttgtaggtttgattgatgatgttcatgatttatcaccgaaaacgaaattagcagttgaattgattgcagcactgattgttattgtatatggtgatatatatttaaaaggttttgattttatgccgagtaattggccaccgattattccaggggttataacagttttatggattgtagggattactaatgcaatcaatttaattgatggattagatggattgtcatctggaatatcaattattgtcttgtttactgtttcaatgacttcgcttacgagtggaagaactgatattgcttcgttgtcattagttttagcaggggcaattatgggatttttattttataattttcatccagctaagatttttttaggagattgtggtgctttatatattggttttatgatttctgttatttcattattaggttttggttataatgtatcgacattttttaccttaggggcaccgattgttgttttgatggttccgataatggatacgttgattgcaatcattcgacgaaaagttaatcataaaaaatttagtgaagctgatcgggcgcatttacatcataatttaatgttcaaattgaaactagggcatcgtaaaagtgttttagttttatacggtgttacttttttgttctctttaacatcatatatttatctatatgatgcaactttaggaactttaatgtttgtcattctaatgtttatttttgaattattcattgaaacaacaagtatggtaagtcaaaagtataaaccggtattaacattagcaaatgtctttattcagagcgaccgcttgcctaagattaaattcttagaaagatatcgggctaatcgcagtgaaaaacgaaaagttattgatcatgttgtaatgctttgttgtttactcatagtaattgggggagcaggtacttatattctttatagtcgtgaaggagcttctaaaaataaccctgcgacggttcctgttgagacgccgtatatacatgaggaaggaaatgagcttttaaatgatatatatgttcgacttgataaagcttataaaaataatttaacaagcgaggaatgtcaattagtagcatcttattttgctgttgattattttactttaaaagataaaaaagatggtgaaattggtggtttagattatatttatccaagcttgcagagtgaatttagctcatttgcttcaaaatcattttatacatatagagaaacgtatccaaaattagaagttaagaattatgaaattatttcttttgcaccatctaaggtagtgattgatgatctagatgataatgaatattataacgtattaatctcaatggaattcaatcgtaaggttgacgaattacctaaaagtgtaaatatagttttagttttagataatgatcgtttttatgtagttggtgttgataatgcttagttatttaaaagtagagaatattgataatgaattgattgaatttcatttacgtcaaaagaattattattctttggaaggacaggtagttactagagaatatcttattaatgagatgcgatgtcctgacggttttgatgaaatagatcattatatagaaaaatgttatttagaaggtgaactagttggattagtcgattatcaatatggctatcgttattcgatgattcatgatgatgaatgtgtatggattggattatttttaattgatcaggataaacaaaattgtggattggggaagaggctgtttaatgactgtttaaaaaaatttaagcgacgttgtgaacggatccaattggcttgtttagtgaggaatgaagctggtttagtattttggaaaaagtgtggatttaatgagattggtaattctaaatatggtgatttaccagtaattgtattagagaaaagaatatagtaggcagctgtcaagaagatttgattaaagtgtcgatgaaatcattgtaattttaaaaatattatgttattatgttctagcgatgtatcaaagtatctaataggaggtatattatgtttgggactattctaaatgttttattagttgttatttcaatagcacttattatattatgtctattacaaagtggtaaatctgatggaattgtaaatgctttaactggtcaaagctcaaacttgtttgcacagcaaaaagaacgtggtgcagatttagtgatgacaagagttactactggtttagcaattgcatttttcgttattgcaatcattctaagaatgtcataaataatagggctaaggtcctatttttattttggaatcgggaggtgaatgaatgaaagaaaagattttggaattgttaagtgatgaaaattatttagagcgttctattgatttgatcgctgctaaattaaattgtaataaaagtgataaatttgtaaacttagttaaacttatgaatgagttggaagatgaaggtaaagtagttagaaataaatataatcattattatcttccaaatcagtttggcatgattctaggaacattaacgattaataaacgtggttttgggtttgtagtcgttgaagatcaagagaaagatatttttattagtcccgatgacttaaaggatgcgtttaataaggatactgtattagttgaattaaagaagcacagtgatgaggaacgtcctgaggggcgagttatcagggttataaaaagaggacagacaagattagttggtgaaatcaaaaaaggaaaacgtgattgctttgttgatgttgatgatccgatgttcgataaaccgatttttgtagatcgcgctcatttacacggagcgatgccgggacacaaagttcaagttgaaattaagacttataaaccgattttaaaaggtgatgttgtaaagattttagggcatcgcaatgatcctgggattgatatcttatcgatagtatatgaacacgatgcgccagttgagtttcctcaagctgtctatgatcaaatagagaatattcctgatagtttggaaggaattgatattggtcaacggattgatttgcgtgatgaggtcgttgttactattgatggtgatgacgccaaagacttagatgatggtatttcattaaaaaaattagataatggtcattatcatttaggggtgcatattgccgatgtttcttattatgttacagaagaatcaccgcttgataaagaagcatttgcacgtggaacatcaatttatttagctgatcgtgttatcccaatgctgccacataagttatcaaacggcatttgttcattaaacccgcatgttgatcgtttcacaatttcttgttttatggaaattgatgaaaatggtgaggttgtagaacatgatattgttccagcagtaattaattcgacagaacggatgacttatactaatgtaaataaaattcttgatggtgatcagacgcttcagttacagtatagtcatgtcaaagatttatttttcttaatgcaggaattagcaatgattcttcaagcgaaaaaagctagacgtggtgcgattgattttgatgttaaagaagcaaaagtactagttgatagtaaaggtaatactactgatgttgtattgagagaacgtggggcaagtgatcgtattattgaagaatttatgttattggcaaatgaaacagttgcagagcattttaaatggttagagctgccgttcatttatcgggttcatgaaaatcctaaaccgaaaaagttattacaatttagtggaattgctaaaactttaggctatacaatcaaaggttcattagaaaatgtttatccgggtgaattaagcaatatcatagaagttagtaaggatactccggaacatacaattattgcaactttattattgcgttgtatgcaaaaagcgcgttatgatgaacagtgtctaggacactttggattagctgatgaatattatacacattttacttcaccaattagacgttatccagatttaatcgttcatcgtttaattagaaagtacatgttcgaaaatcgtttagatcgtcgtactatcatgcattatcaagaattgatgcctgaaatagcactacaaacttcggctcgtgaacgtgaagcgattatgattgaacgtgaagttgatgatatgaaaattgcggagtttatggaaaaacaaattggtgaggaatttgaaggaattattagttcagttactaattttggtttctttgttgaacttgataatacaattgatgggttagtccatgtaactgatttgactgatgatttttatttctttgatgagaagaatcttcgttatattggtcagcgaacaggcaaggtgtttaagatgtctgatcgagttaaagttcgagtatcaagtgcatctaaaaaagataaatcagtagattttgaaattgttggcatgaaatccaacaaaaagacaacaaaaactgttataataaataagcgcaaagataatgatcgtaaaaacaatcgaaaacggaatgatcgtcgtaaaaagcgtcatgaagaaccacgttttacaaataatcattttaaacgctctaaaaagggtaaatctaagcgtcgcgcttaattaatcagaaaggggaaatgggcatgaaaattgtatcaaataacaagaaagcttatcatgattattttatcttagatacatatgaagcagggattgaactaaaaggaacagaaattaaatcggtccgtttaggtaatgtaaatcttaaagatgcttttgtaagaattaaagataatgaagcttatattgaaaatatgcacatttctccttatagccatggtaatcaatttaatcatgagccgttacgtaatcgaaaactattacttcataaaaaagaaattttaaaaatttcaaataaattaaaagaagatggcttgacagttgtaccaactaagttatactttaatacaggaagtaaagtaaaattggagattggaattgctcgcggtaagaaattatacgacaagcgccaagatttaaaagaaagagattctaaaagagaaattgaaaaagctcttaagaattactgatctgggggtgtcctgggttcgacaggtgtatgtctgaccttagctgcagtcgaaggcattcgttaaatgcacaaacaaataactggaaacagacaaactaattacgctttcgcttagtcgacatagacatgaaagctgccactatttagcgtgcctatagctatttaactggtatcataaactcataggataagggtatttattgcttagctaaatacttcgaaaatctcataagctcgttaggtggaaaattgctcattgattgtagcctaattaaattaattcaatgagataaactgtagacgctttggagggattatgcttggacaggggttcgattcccctcacctccaccaataaagcaattgaccgaatagataaccaatctattcgtttttttatataaaaagaatgtgtttctcatgaattatattttaaactaatttgataatgattcattgtatttttcattggattatacaaacgatgtttggagaaaagaactattctaagaaatagagcatatgtatcaaactactaggtttaaacgaaaaagatacaaaaggaattattgaaatatgtcaaggattatgacttaataatagttattggtttgttaaagaagattatctagatatatttagtgataaaaatctatatataaattcatttaatacaaaaattgcttctattacatttactaggtaaggaagctatactagatcttccttccgtttatcacctgagtttacaactaatggtatgcttgcaaaattaaaaaggcaaggcgatgctttataagtcaagatatttcatttacccctattggtagattagttaaaactggtagtatcgaagcagttatagattattataaaaatattggagatgattattatcaagaacttatagttatgcaatggacagtgattttaaagacataaatacttatgtttcaactcgtcttccagcaacctatcaaaattttataggatttgttgaatcactaatgtcaaacaggcaaaaataaacttggaaagttaataaattataagtttgatagaaaaacaaaatataaattatcaaataaacgtttaaaacaattagaaaagctaattcaagaaagagtaatattattagatcaataagattattctttttttatgggctattatgtcttaataatatctaaactgagtattaagaaattgatggttgaggtaaaagtgaaaaggattaaatgttaatcttttttagctgatttatctttgtaaaaaatatattttatggaaatacaaatgatagattatgatttggtaagtgaagatatgatattcaaaatagagttcgaggttaagagataagtcttaaaagaaaatatatagcattaatttaaaaatctgttagtaacttttatatgaaaatattttttagaaaattagacgaaataaattattgtttggaattaaatatagtattatagaattaagaagtataaattatggggatatagatatgaaaaattattatggtagtttgtgtacagaaatgtatgagatcttgcataaggatgcaccagaagacgaattagatttttatctatcttatactagaaaagatatgtcaattttagaacctttatgtggtagtggaagatttttagttccatttctagaaagaggatatgatattaagggaatagacttatctaaagaaatgcttgcaaaattaaaggaaaagtcacctaatgctaaagtgtttcaaagtgatatactggagtatgatactgtagaaaaatatgattacatctttatttcttctggttctgtatcattatttacagatatggtattatgtagaaaaattttgaaaaaaatgaagtggttgttaaaaaaaggtggcaaatttgtttttgcagttgatacagtagcgaatagatgtcctgatgattctgattatcggactgcaatagctataaagactaaagaaaggtatgatttgattcttaaaaataaaaactattacgatgaaaaaacgcatacccagttttctccaagtatttatgaactatataaaggagcagaactgttgcaacaagaaattatggattttcagacacatttatatgaattgggtgaactagaacaacatttacaggatataggatttacaagtataacagtgtattcatcgtatgaaaaaataattgctaaaaataatcatacagaaatgttcttgtatgagtgttcattttaaaaaaagggatggataaagatgatagtcttaatcacaggagcttcgcatacaggtaagacagcgcttgctcaaaagctgcttgaaaagtataaatttccatgatcatctgaaaatggggctaattcgtagcggaaacactgaattaacacctatgagtgataatgatgctctaactaaatatttatggccaattgtttgtgaaatgattaagaccgttattgaaaataagcaaagccttattattgaaggatgttatattccttttgactggaagaaaaatttcacaaaaaaatatttggataatataaggtattattgtcttataatgcgtgaaaattatattagaaatcattttgatgacatcaaaaaatatggtaatgtcattgaaaatcgtctagatgatgaaaattgtactctggatagtgtgttgaaggataatgctcagttttctaaacttgcccaaaaaagtaagatgaattacatacttattgacgatccatataaaatagatattgatttataataattattgtttatgctataagaatcaaattaatatttatactattcttaaattttttattgttctatttttaatggtttatttagtgaaggtcatttactaaatttttgctacttgatataattatagaaatggtagataaatagaacaaaaaattaatgtatagatgaaagaaaatattagtttaagtgaataaaggagttagacaatactggctcatgattgaaaattttaataagcacattttttaaataagagagaaaaactaaaagaataattatggattagataaggggatgtgcctggtaattactttgtaaaaataattcaggtctatttaactagtttgggacaacagatttattgttatttgatagattataatatattgattttatgtcttacggtagtaattaagtagagggatgggaatatgaaagttaagaaaacaagacggcaattttatgactcgatttatattttggcaattaaacacggattaatgctagcaataccattcctcattcttggctcttttgctttgttgtttaatagctttccaatccccgattatcaagtctttttagcggcttttctagatggaggcttaaaagacggattaagcattatttataactgttccttaggttctattgcgttaattttaattattactatctcactttcatacggaaaattaaatggtcaagatgatgtctttttttatcctattacagcaataatttcatacctttctttttgtggcggattgcatgaaaagacatatatttttcaatctgactgggtctttacggcaatgtgcataacccttttaacttgtgcgatgttaaaaaagggaatgcaccttgtaaatcatttagaaaaattgtatacggtagggacaaattatatttttaatcgagcaatacaaggaattttcccgatagtctttatcattattatatttacgagtgctgggcagattatgaaaggtttattaggtgatatcaatattgttaattttggctcatatttctttatatatttgtttagctggtttggtaatggaattattgggaccttgttatatgtattttttgtacattttttatggttttttggaatacatgggactaatacactggatatggttgctaagcagttgtttgagccgggagtacaaattaatcaagcgttaatacaaaatggtcaattaccaacagaattattttcaaaaacatttctagatatatttgtttttattggcggttgtggaacagcattatgtttaattttagcaatctttattgctgctaaaaaaagtaataataagaaacttgcgaaggttgcaggtatatctgtttttttcaacattaatgaaattgttatttttggttttcctgttatttttaatcctattatgctgattccttttattttgataccgttagttttaacaataatcagtagtattgcaatgtcaactggtatagttccgtatataagtcaatcggttgaatggacagttccgattattttaagtggatatcaggcaacgggatctatcgcaggtagttttctccaaatatttaatattattatcggaacaatgctttatattccatttgtaaagtatagtgagcagatccaaagtaaagaatttgaagaatctattcttgccttagaaaatgatatgattgaaggagaacaaaatggtagtatccccgtttttttatcagatcattatcactatcattttcccgccaaaacacttgctatggatttgcgtaatgcgatgtatttacatcagctgcaattatattatcaggtacaaatgactgcggaggaacaagtatatggtgtagaagcgttgttgcgatggaatcatccagtttgtggttttgttgcaccttcattattgatttctttggcttaccaaggtggttttttgaatgaactaggtttatatattatagaaaaggcttgtcaagatgctgagcagatagatagattagcgatgaagatgaatttgtcaatcaatatttctccaaagcagctggaggatgctgattttgtttctaacgtacttaaaattattaataagtatcatttgcaatatatagaactggtttttgaggttactgaacgagctttattgaatactactaatattattacaaagcgcatattagaattgcgagatagtgggattaagttgagtatagatgattttggaatgggacacagttcaataacttatttgcaggaaaatatatttgatgaagttaagttggatggtagtttggtacagcatctattggaaaatgacagaacacgcgaaattattatgagtattactcaaatagccaagcggttaaattttagtgtagttgcagaatttgttgaaacagaggaacagattaatgtattaaaagaagctggatgtaagatttatcaaggctactattatgctaaggcagtaccattagatgaatttttacaatattgtcttattacaaggaatggtattataagatcgccaataaatgagaaagtttagtgttctgataataaaactaagggggtaaaatatggatgatgaatttattaatataacgacagaaaatgtttttaatgaacacttatgttgtattatacggagtaaaaagtttcatcctggaatagatgcaaagcgccaatggctttcaaaacgcttaaatgaaggacatgtttttagaaaattgaatgaaaggggtactgtttttattgaatatgccccattggaaaaagcatgggttcctattgttggtgataattatttctacatatattgcttgtgggttatgggaagctataaaggcaaagggtatggtaagtcactgatggattattgtttggcggatgctaaagcaaaaggaaaatcaggtgtctgtttactaggttcaaaaaaacaaaaacattggcttacagatcagtcatttgctaaaagtaatggctttgaggtcgttgatactactgatgatggatatgaactattagcgttgtcttttgatggaactttccctcgatttactcaaaaggctaaaaagcaaaagattgaaaataaagaactaactatttattatgatatgcaatgcccttttgtttatcaaagtcttgaaatagtcaaacagtattgtgagattaataatgtacctattctgatgattcaagttgatactttacaaaaagctaaagatttaccttgtgtttttaataattgggcagtgttttatcatggggaatttgaaactgtgaatctgctagataaaaatactcttacaagattattaaaaaaatagagattataaatatataaagattggaattaaatggctgaataagccatttttttaatttttattttaaaagtactttcaaaaacattaaaaataagttggaataaaaaataaaaatgaaagtaattactaaagcaagtgaatatattgcttaataaaataaaagccattaaagttataaacaaggaggagagatttaatgaagaggattcaaaatagtttgatcgtttcatgtcaggcattagaagatgaaccgctgcattcatcattgatcatgtcaaaaatggcacttgctgcaaagatggggggagcaaaaggaataagagcaaatagtgttcaagatatccatgaaattaaaaaggaagtggatttgccaattattggtatcatcaagaaagattatgaggatacagatatttatattactacaacgatgaaagaggtggatgctctagtggcagaaggggtagatattattgcgatggatgcgacaatgcagttaagacctcataatcaaacaattactgaattttttaaggaggtaaaagcaaaaaatcctcatcaattgtttatggctgattgctccactgtggaagaggcaatccatgctgataatattggatttgattttattggaacaactttagtcggatacacaccacaaagccaaaatagtcgaattgatgctaatgattttaaaattattagagagatagtgaagaatgttaagcatcctgtgattggtgagggaaatatagatactccttctaaagtaaaaagggcattagaattaggttgttatagtgtggttgtaggatcaatgattacaagaccacagttaattacaaagaaatttgtagatgagatttcaagataagggaggaaagagattatgatggataaattgtctaatgtgttattgccgattgctgagaaactttctaaaaatcgttatttgacagcaattagggatggttttgtttcaatcatgccgctagtaattactgcgtctttatttacattgatcaatagtgtatttgtaggtgaggggcattactttgatcaatggtttggagcaccatgtaatgattttgctaaaatcggtagtgtaattagttcagcctcaatgtcaattatggcaattttgctagtttttactactgctaaagctttagctaatgaatataaaatggatacttcggttgctggagcaacagcagttgtttgctttttatgtctaacaccatttgtaagtgatgcaaaaattggtgaatatgtgactacttattatttaggggcagctgggatgtttacagcatttatttctgccttgatttcagttgaattaatgagatttttgcttgggttcaaagcactggttattaaaatgccggaaagtgtacctactggaattgctagatcatttaatgcaattattcctgtagctttaacggttattatttttgcaatcctgagaattataaccgatgcaataggggcgccgcttaatgatttgatttttaactggattcaaacaccttttactgcaattgtttcatcaccggtcggattgattgttatttatgttttgtatatgcttttatggggctttggaattcattcggcatatatttttaatccaatcttagaaccaatctatttggcaagtctagcaatcaatgaagctgctattacaagtggaacagcagctaccgaaattattactaaaccatttattgattccgttgcatttatgggtggcgctggtaatatgttagcgcttgtaattgctatttttatagtttctaaaagagatgattataaggtgattggaaaattaggttttgtaccagcattatttaatatttcagaaccgctgatgtttggattacctgttgttatgaatcctatcttgatcattccaatgattttaacaactcttgctggtttaggaattggagcgttagctacacaaattggtattatggctcatacttacgtattgatcccttggacgacaccaccagtaatcagtgcgtttctagctactggaggagatattatgtcaggggtcattggtctacttattttggtagtatctgttcttatctatatcccatttgtaaaagttatgaataaagaaggaattgagagtattgaagaataaagttattgtttttgatctagacggtacacttttaggtgccaataatgaaatcattggaggaaccgagacattgaattgtcttgattctctccaacaaatgggatggacattagcaatatgtacaggtcggttagatcatgatattttaaaaatagaagaacaatacaaacttaaaatagagcatcgtatttctcaaaacggtgcggtttgtatgaaaggacaacaattgatagctaccttgattgataaacaagaagctataaatatctataaggagattcaaaaagaagatattcgaatcgagttaaatacagtatctaatcgttattggaaaagtgaaagagatccagctttccctagtgaattatatgattcccatatcatttgtaaagattttgataaacttatactgtatcagccagcagttttgtttcttgttattggtactgaagataaacttcgctcaatagaaacatatataaatacaacataccaaaagacaaaagcagtgatgacttcttcaacatctttggaaatcatgcataaagatgcctcaaaaggaaatgccgtaaaaatgctatatcctaaaagtgaagtatatgcaataggcgattccccaaatgactttgatatgtttccaattgctaaaaagggttacttggttgcaaataagccttgtcaatttccctgtgctcaaaaagaaagtattttagaagcgttaaaagatataataaaaataaataaagaggacagataaaatgaaaacattatttattcctttagatgaacgaccatgcaattataattttcctttaatgattgcccagtcaaatcaacaaatcgaattagttgaaccggataaaagttttttaggtcataaaaagaagccggctcaggtggaatattttaaacaatttatcgatgaaaatattgaaggatgtgataattgtattatctcgatagatatgatcgtatatggtggattgattccatcacgattacactatttgagtgaaacagatgcgcttcaacgtttagaactaattaaatatctaaaacagttgaaacctcaaataaaaatatatgcttatcattgtattatgcgtgcaccaagttataattcgagtgaagaagaacctgattattatgaaagttacggctttgctctttttcgaagaaaatatcttcttgatctaaaaaaaagacatgggttaaatcaaaaagaaaaagatgaacttctcggtattgatattcctcaggaaattataactgattatgagcagcgtcgtttgtttaatactaagattaatttaaaggttattgattttcttgaagctggctatcttgattttctggttattccacaagatgactcgtcaccttatggatatactgcaatatcccaaaaaatcgttattaatgctttaaaggaaaaaagattagatcagaaagtaatgatctatcctggagctgacgaagtaggtctgtcattattagcacgtgcttatcatgaatactatcatttagaaccaaaagtttatcctttttacgcttcggtattaggaccaatgattattcctaaatatgaagatcgaccaatgtatgaaagtctaaaatcacatgtacgcgtatgtaaagctaagctggtcaacaatcctcaagatgctgatgtggttttagcgataaattcgccaggtaagatcatgcaagaagcttttattgataaaaatgatttagatgtaacttatacaagttatcgttatttattggcttttgctgaacaaattcaagattatataaatagtggttatcatgtggcgttatgcgacagtgcttttagtaatggtggtgatctacaattaattgaatatttagatgagctaaatattttagatcaattagtaagctatgcaggatggaatacaaattgtaattccttaggaacaactttatctcaagcttttattggtcaggaaaacgtaattaataatttatgttatcgtcttatcgaagatgttttttatcaagcaatagttagaaaagaagttgtcgaaaatgatttaccacataaaggattatcttattatgattttaaagatcaacaaacggatgtagagaatattattaaaaagaagttacagactaattttggacatcttcatcttagtcagcgctatccttttaatataacaaaaatatatatgccgtggaaacggatgtttgaaattggaatggaaattaagttataggaaacgtaagtttcctttttatgctataatcatttgtatagtaaaggaggggttaggtgttatcttataatagaagtgtgattccaattattgaatcagcttatgaagaactaacgaatgtggaaaaaaatattgctaattatttcattgatcaagttgaagatgaagatttatcatcaaaagcggtttctcaaagattatatgtatctgaagcatccttatcacggtttgctaaaaagttagggtttagtggatatcgacaatttctatttgcttatcaagattctcaccaatcaagccggcatttagatttattaactaaacaagttttaaactcttatcaaaaagttttagagaaaacttattcattgattgataatgaccaaatggttagaatagctaagatgctggatgaatataatcgagtttatatttatggaattggctcatcgtcagttgttgcaagagaatttaaattaaggtttatgagattaggattagatgttgattatttagcagaatcacattctattcggatgaatattacccgagtaaatcaagaatcattagtgattggaatcagtgtaagtggaaaaaccgaagaagttatagaaggattacgagaagcaaaagaaaaaggagctaaaacaattatgttatctgctgctcgggtatatgaatatcgttcttattatgatgaactgatcttgattggggggttaaaaaatttagctatttctgataaaatctcaccccaaattcccgccttgatcgtggttgatatcttatattcacattatcttaattataacaatgataataaaaaagaaaagctgcaaatgacattagaacatattaattatgaattagaagaataatctagtatatggatattggtaagctcatattaaaaagctaacagagtgctgctttgttagctttctttgtgaataattaattaaaatagaactttttgcagttcctctaaaaacattttagcagaacggctgaaaatttgatattttttccagacaagataaaatccagtttcaaaatttggttctaatggtcggaagcagaggttacaatcaccggttgtattaattaatttatcaaatgtaaaaacatagcctaaaccactttctacgatcattgctggggtagtgataagattaaagctgccaatcacatttagattacgataatattctttaaaccagcctgataatacgtttgcacttgattgttgatgggcaaggaaaataggttcgtctttgatatcttctggagtgattgcatttagttttgctaatggactatctcttcgcatcagtacaccccaagtatctgtatatggtaacttaagataattatatttttctagatcgattggttcaattaagatggcaaagtctaggagacctttatttaactgttctgaaacttctaaagtacttccgctaaaaatatgatacttaatattagggtattggatgtgcatccttttaaaaatttcagcaattgaatgcattacataagtttctggggcgccaatatagatatcaccggatgttgtttccccataggtgctaagttctgattcagttcgttcagttaaatcaattatttctttcgctcgttttctaagaaacatcccttcttctgttagagtaacttttcggctacctctttcaaataatttttttccaacctctgcttcaagcatatttaattgacgggataaatttggctgggtagtgtgtaaaatttcagcggcttttgtgatactttcttcttgagctactgcaagaaagtattttaaaatacgtatttccattaatattgcacctccatttaaaaaattataccataaagaaaaggtataataatatatataatataagcatttgtagtttttttaaattgtgagataattatagaaaagataaataaaggaggagaaaaaatgagttttccaaagaattttttatggggcggagctactgctgcgaaccaatgtgaaggagcctggaatgaagatggacgtggtcctgctttaacagatgttactacaggaggatcagttaaagaaagtagacaggttacttatattgacaaggatggtaaacattgtaagatcgttactagtgaagggcaggttcaattacctgaaggagcccattttgcttgtttagatgaatgtttataccctaaccatgatggtattgatttttatcatcattataaagaagatattaagatgtttgcggaaatgggttttaaaacttttagaatgtctatttcatggtcaagactatttcctcatggtgatgaagagacccctaatcaaaagggaatcgaattttatcgtagtgttttcaaggaattaagaaaatataatattgagcctttagttacaatttggcattttgatacacctttatatttaattgaaaaatatggaggatggtcaaatagaaaattgatcaagttttttgatcattatgcacgaacagtttttacagagtttaaaggtttagttaaatattggttaacttttaatgaaattaataatacaatcatgggattaggtttattctatgaggctaaagaagaggattatcaacgtgcttatcaacatttacatcatcaatttgttgcaagtgctcatgcggttaagataggtcatgaaattgattccgaaaataagattggttgtatgatttgcggtattacaagttatccagcaacatgtgatcctaaggatgttttagcaaatcgtcatcaatgggaaaaatcaatcttctattgcggtgatgtccaatgttttggtaaatatccgacttatgctaaacgtttatgggatgaacataatgttaaattagatattacagaacaagatttaatcgatttaaaagaaggtactgttgatatgtatactttctcttattatatgtcttctttgattacaactcatgagattgctgatgcagtaggtggaaactttacaacaggagcacgaaatgaatatcttcaatattctgattggggatgggcgtttgatccagatggattacaatattatcttgaaatgatttatgatcgttatcaaaggccgttgatggttgtagaaaatggtttaggagcttttgatacagttgaggaagatggaacaatccatgatgattatcgtatcgattattatcgagatcatatcttggctatggataaagcaattaataatggtgttgatttaattgcatatacgacttggggctgtatcgatctagtttcggcaggcactggtgaaatgagaaaacgttatggttttatctatgttgataaacatgatgatggaactggaacgatgaaacgtagtcctaaagattctttctattggtatcaaaaagtaatacaaagtaatggtcaagatttagattaattgagtatttaattttataagtaatgattaactgtattgtcatataaagatgacgatacagttttttgcataaataaaaagcatggaaaaccataaaatataagtatttgtattttcatggcttttattggataattataagtgtagaataaaacggcttgaaaggagatggttaaattgaatgtgcagaaaattagtgaaaaagaaattgttatagcactgctcgatgctggtatggatacggaaaaaatcaatgaatttattgaaagtattaactcagaatattttcaaaaaagtaaaaatattttattaagccaaagagctgaattattattaaagattcgagatggtcaagagaaattatattgtttagattatttaactagaacactcaatcaggcaggaatatttgataaaaaataatggaggaaaaattatgatcttaaaggaaaattataaattaaataatggggtagaaatacctaaattagggttaggaacttgggaaattgctgataataaagtagctgatgcagtaaagaaagctgttaaactagggtatcgccatatcgatactgcccaaggatatgagaatgaaaatggtgttggaattggaattaaaacttgtggtgttgagcgagagaatctttttataacaacaaagattcaagcagattttaaaacatatgaagaagcgagacgatctattattgattcattaaagagattagagcttgaatatattgatttaatgatcattcatgcaccacaaccatggacaaaattcagagaagaaaatcattattttaaagaaaatatagatgtttggaaagcactggaagagttttataaaatggggaaaattagagcaatcggtttatcaaattttgaaatcgtagatattgaaaacattttaaataattgtgaaataaaacctgcggttaatcaaattttggcacatatttctaataccccatttgatataattaattattgtcaagcacatgatattttagttgaagcttattcaccagtaggtcatggagaaatgttaaaaaataatgaagttaaattaattgctgataaatatggggttacaattcctcaattgtgtattaagtattgtttacagttagataccttaccactacctaaaactgctgatccaggacatatgcaaaataatgcggatttagattttattatcagtgatgaagatatgatgcttttaaaaaatattaataaaattaaaaattatggagagtttagtgtatttccggtatatgggaaaatttaactcataaagaagaaattatataaatgaagggagattattatggcagctttaacaacgttatttccagtattttttatgctggcactaggctttatcgcacgagtaaagggatggatcacacttgaacagaaaaatggagctaatgcaataatatttaaaattttatttcctattttagtccttaatttgatgtgtacagcaacgattgaaacagaccatattaaaattattggttatgtttttggtgtttaccttctagctttagttgcaggtaaattacttgcaccacttgcgggcaagaaatatgctcatttttcaccttatttacttacagtagtagagggaggaaatgtggcattaccgttatatctttctattgttggaaaatctagtaatactgttatttttgatattgctggaacagttattgcttttattgtttttccagttttaatagctaaagaagcggcaacaggttcttcgatgaaagagatgattaaaagtatttttacaaattcttttgttattgctgtgattgtcggtcttgttttgaattttacggggatttatgatttactgatagcatcgcaatttggtgaaatgattacaggaacattatcacaagccacaacaccgatcgtttcaatgattttatttattttaggctatgatttaaatgttgataaaaaaacattagtaccgattcttaagttaatgggaattaaaattgtttattatgcgatggttattgcgggattctttattttatttcctgcccaaatggccgataagacttttatgatggctccaattatctattttatgtgtcccactggatttggattgatgcctgttattgccccattatataaagatgaagatgatgcctcatttacaagtgcctttgtttctatctttatgattattacactgatcgtctatactttggttgttatttttattgcttaaaataagcgtgctttcttattgatttagaggagctttaagataaataatagtccatttgaccttttgataagaatataaattaaaaattaggagaaagattgaatatggaatatatacaattaaataatggtattaaaatgccaagtataggctttggtgtataccaaattccattattaatgacaaagcaatgtgtcttagatgctttagcaattgggtatcgacatattgataccgcaaggaactatggtaatgaaagagaagttggagaggcgcttatagattcaggtatttcgagagctgaaatctttctaacaactaagatatatggggctgatagttatcgtcaagcatgtcagtatattgatgaagcattaaataaattacagacaaaatacattgatttaatgttgtttcattggccatctggaaatataacagaaacatatcgagcgatggaagattattataaggccggcaagttaaaagcgattggcttatcaaatttttttattcatgattttaatactgttattagttcatgtacaataattcctatggtcaatcaagttgaagcacatatttttcatcaaagaaaagtttttcaaaaagatatgaaccaatatggaatcaagcttgaagcgtggtcaccactggcatgtggaaaaaataatatctttggcaatttaatattagaaaaaatagctaaatcacatcgtaaatcaacagctcaggttgctttaagatttttaaatcaaaaaggtattgcgattatacctaaatcgatccataaagatagaataaaggaaaattgggagatttttgattttgaattaacaaatgatgaaatgaaagaaattgaattattagattgtgattgtagcttatttagctggtatgaataagtaaataatttatttagcggtagttagagaagaataacaaaaaaaggaggatgttaagaaatgaaccttccctatcatgtccaaataagggagattcacttcattagtcgtccttttttatagtttatttgtagtcacaataaacactgttgattgtattattttcgataactaatttacgttgagctagtttgtcgatgaaataacgatcgtgtgatacaaataataatgttcctgaataatttgaaagtgcatcttctaaaatttcacgagtttcaatatcaatatgattagttggttcatctaaaattaataagttgactttatgttgcattaaaatagccatttttaataatactttttcaccaccagataagtttcctactcgtttgaaaacctgatcttgataaaaagaatatttagctagaatccctctagcctcaccttccaaacaaggatattcatgacaaaatgtttgaagaattgaatcattgttattgataaaatttatttcttgaggtatatatccaattaagactgtttccgccatttttaactcaccttgataattattaaggtttccaagaagagctttaataaatgatgttttacctgaaccattatttcctagtaggactgttttttcctgataataaagtgtaaaattcacttttgaaaataaagatagattattaaaagatattccaaaatcaatgactttaagcacttctttgctactgcgttcacccaaaaagttaagtggcagtttctttttttctaattgtggtttatcgaggatttctatcttttctaaacgtttttctaattctttggcttttttaaagaatttttcattatcaccttgattaccccaatctcgataacgcttgatagaagcttttattgcttcgattttcttctgttgagttttgtattgttcaaattcttgtaataataatctttcttgttcttttaaggtgtatgagtaattaccgtggaataaacgattttcactgttatctaaaagaatagttttattagttactcgatccaaaaaatagcgatcatgtgaaataatcacaatagtcccacgatacttatttaaataattttctagccattctaacattgtaatatctaaatgattagttggttcatctaataataagatatcaggttcagttaaaattaattgggctaaattaataattgttttttgaccaccgctcaagatagcaaacggcttatctaaaatactatgcaatttaaagccggtaatgactttgtttagtttttcttcaacttcatagccgcccagggctatgtattgatcttgtattttagcatatttgtttaatatcgcttcatcgacattattatgcatcatatcttgttcaagtgctcgcattcgttgttcaatagcatgaatttcgaaaaaagatgacatcagcatatcttttactgttatatcattatcactgattgttggaatttgttctaaatagccaatagtagcttgtttgcgaatagtaatatttcctgtatcagggaattcttttttcatgatcattttaaacagtgtagatttgccactaccatttttgcctacaattcccacacgatcaccagttaaaatctcaaaattaatatcttttaatacttgtttataaccaaaatttttataaattttatgcattcctatttcaatcattgtatatttgctcctttattttataaatttatttaaaataaacagagcctaagattaataggatcaggcgattgtttctaatcgcttcgcacagctagagcattatactctgatcgcctagcctattgattaacagactctgtacgaagcacagtgccttcgactctacggcaaacataacctagaatcatcatgaccacctccctaaaatattattattttattaattctatcatatctaaattataaaaacactgaattaataatgaaaatcattaagtattggatatttagtgattaatatcgaagaatctattgataaataagaaatatatttgtttatgaaatcgaactatagtagaatagtgaagaagaaaatatttataagagaggtacattaatgaaaagaaaatatcctaaggtcattatatctgaagaaggagaaaaatggcttgataaaggtcagatgtggatgtatagaaataatgctgttaatattgatgaaacaattgaaaatggagcgttggtagatatcattactactactggccgttaccttggaacaggttttatttctaaaaatagtcacattacggtaagaattttatctaaagatataaatgaaatatttgatcgaaacttttttaagcgaagaatacaatttgcttatgactttcgcaagacagtagaaaaagaaaatttaactaattgtcgtttggtttttggagaagcagatgaactgccgggattaacagttgatcgctataatgatattttagtttgccaaattagttcatacggattagataaaatcaaagatatgatctatgaaatattactagaggttttaacagaagatgggcaagatgttaaaggtatctatgaaagaaatgatattaaggttagagtaaaagaaggactgcctttagaaaaaggatattggagaaatattaatttaccgacaacgacgattattaatgaaaatggaatcaatttaagtgttgatgttgaaaatggtcaaaaaacaggttactttttagatcaaaaagcaaatcgtgttttacttagaaatatagtgtatggaaaaaaagttttggattgctttagtcatactgggggctttgcattaaatgcggcttatggtaaagctaaagaagtggttgcagtagatgtatcacaaactgctcttgatcagggatatgctaatgctaaactaaataatttacaaggatgtatttcttttgtaaaagatgatgtttttgactatctagataaatgtaaaaagggacagtttgatattattgttttagatccacctgcttttacgaaatcgagaagaacggtagatcatgcttataatggttataagaaaatcaatatgaaagcaatgaaattattaggcagaggtggatacttaattacatgtagttgttcacgttttatggagactgataattttgaaaagatgcttcgtgaatcagcgcatgaggctggagtaacccttaaacaagtatcagttactcaacaaaacccagaccatccaattttatggacaatggaagaaacgtcatatttaaaattttatattttccaaattatttagattgaataggatttacgaatcgactgaataggcttttaattttaaagtttaatagtcgatttttatttaggaaaataatttagatatttttgaataatatcttatttgttgtgtattgaatttggtttgtttcatgattttccagaccacaagtataaagggcgttatcatgattatcgttcaataattgctaaaggaactatcaagttaattgatggtaatgatgattacaaaattaaaaaaggatataatttattatccacctgcaaccatcgtgaaattgtccttttggaaagtagaaagacgatactcccaatatatatcggagtgattgaatgtaaaatgaagaatgttacagcgaagtctgaatttccaataaggtcagttgcagatgttccatttttagatgtatgatcattacctaaagatgaaacaccatttgatataagtgacattattgcgaaacgaaaaaataatttattgtaaaaagagaaataacaattttagttctctttttatctttatgtaatattatcttttatcatatttaaaaatgtttcagcacttttggtaaagagttggtattttttccaaattattagcatattcgcttctaattttggttcaagtggtctaaagcataatgaactattattagaattaaaaattttatctaagcataaagcatataaatttccttcttcaactattaaagatgcattaaataataaattataagttcctacaatatttaatttcctttgatttccaccaatccatccagctaattcattttttaccatcccttgatttgaacaaagaagaggttttccacgtagatcatcaggggttattttgtcaagtgatgctagagtactatcccgcttcattaaaatcccccaagcattgctataaggaagccttaaataatcgtacttatttaaatcaacaggctcaataacgattccaaaatctagaactccagcatcaattttttccattacctcttcagcttttccactatgcaaatgaaattttacatgagggtatttttccaacatcgttgcaattgtcttggcaatcggacgcattccttcactctcaccacatcctagataaatatcacctgttaatagttcttcattagctttgacttcagcttctgccctttcaacaagtccaagaatttcttctgcccgttttcttaagatcatgccttcatcagtcaaagtaatacgacgttttccccggataaataattgttttcctaattcttcttctaactctttcatttgtcttgataatgttggctgcgttacatgtagatattcagctgccccagaaatactttcttcccttgcgatggtaagaaaatattgtagtgttctaatttccattaatatcaccccatagttatattatagtacatttatgtttaacaagtataaaaaactagattataaatacatataatctagaatttatttaatgaaacatatcttttttgatgaaaataattgtggcgataatacaggcaactattgctagtcccgttgggaaccaccattgtggaaatggtaaacctgcaacattcattccataaaaactgaaaataatatttggaatagccataacgatcgtaataactgttaatactttcataacaatattcaggttattggaaataactgaagcaaatgcatccattgttcctgataaaatatttgaatagatattacacatttcaattgcctgatggatttcaatcaaaacgtcatctaataggtcttgatcttcatcatataatttaatagctttcccacgcataattttatttaatgttatttcgtccgtttttaatgaggtagaaaaatatactaatgatttttctagtcctaacatttgaatcaattctttattttgcattgatttgtgtaatctttgttcagttcgagaagagatccgatcaatttggcgcagataaattaaatatcgttgagaaattcgtaataataatagtaataaaaatcttgtttttaaatcagtattgacacctttgatccgaccttgtgccatatcatcgatatttaagttttcatataaggaaatggtaacaacgtatcctttcatgatcacaatacctaagggcaatgtcgtatattgtaacatatttttatcgtaaccatcttctacttcttcagcactaggatagtcaacgattactagagtctgattataatcttcgtcatagtcgatatgcgagctttcttcagcatctaatgaagatttaacaaattccggtagaattcccatttcttcaatcaaatagtttttttcttcttcagttggagcaatagcgctgatccagctgcctggttctggtttatcgatcttttttgtttcagttccaaaagttttgtaaaattctaacataataacctccacttacaggaggttcatgtttatgcctcctgtttctctattttattttctttttcttagcgcacaatcgctcgggcacaggggacataaaaacaccttctttcgacggttaattatatcacaaatttatcaattttacccctatgttttgttagaaaatgataaaaaaatagttaaatttaatcattagataaattatcgccaaataatcttctaaatatttcattgattatgaaataattcactataatatgtatatgaatcaactagacaaaagtgagcaagaaatgtcgggatgttaggattgaagatttgttatgattgatttgacaaaggagaaacacaatgaattggactgatagaattagtaacgctttaaaatacattgaagagcatcttaaagaagatattaagattgtagatgttgcaaatgaagcatatgtttcaagtttttattttcaaaaagcatttagaattctatgtggttttagtgttgcagagtatattcgttatcgaagattatcactagccggtagtgaggtcattactacgaataagaagattattgaaattgcattagaatatggttatgattcaccagatagttttactaaagcattcactcgatttcacggagttactccgactgtcgcaagaaaagagcaattgatgattaaatcttttgctccgttaaaaatacagtttactttgaaaggtggttcaaccatggattacaaaattattgaaaaagaagtatttacagtcttaggtaaggcaagaaggtttgattttgattgtgcatttaatgagattcctaaattttggggagagcatatgcagtccgctgataaaaaagtgtgtggtgtatacggggtttgcattgaagatgaaaaagatgaaggatttaaatatttgattgctgatgagtatgttttggacagtgaaattccagatgggtatgaagtttgtgaaattccacaattaacatgggcagtatttgcttgtcatggtgctgtacctaaatcattgcaagaagtgaatacaaagattttttctgaatggttaccaaataatgatacatacgaagttgctgagcattataatattgaaatgtatacaccgtgtgaggactatccacgaggcaatcatgatgaaaattattattcagaaatttggattccggtaaagaaaaaataattattatatttaagttatgataaattaaatcgttatcataactttttcttattgattgacggattttatgatttcctttacaattaagacattgttttaaaaaggagacaatttgatgaacagagaaagattatcatcacgtctaggttttattttattatctgctggatgtgcgattggattaggaaatatttggcgttttccgtatatggttggaaaatacggtggaggggcatttgtattagtctatttatttttcctaatcatattaggtttaccaatcattgtaatggaatactcagttggacgcgcttctcaaaagagtattgctaaaagttttcatgttttagaaaagaaaggacaaaaatggcacatattttcgtatgtcgcaatggtgggaaattatttgttagtaatgttttatacgactattgccggctggatgctagcctattttgttaaaatgttgaatggtgattttattggactaaatccaagtgaagtcaacaatgtttttgtcagtcttcaagcagatccacaagctagtattttttggatgatcttgattgttgtgatcggctgtggaatttgtgctgttggtcttcaacgaggtgttgaaaaagtaacgaaagtaatgatgggattattgctaggagtgatgctcttattagttgtgaagtctttgagtttagacggtgcaataaaaggagttgaattttacttagttccagattttaatttattgatggaaaatggaatctttaatgctgtttatggtgcaatgggacaagcattttttactttgagtattggaatggggggaatggctatttttggtagttatattggtagagaacattctttaactggcgaagggttacgtgttttagcgctagatacttttgttgcaacaatggcaggattgattatttttccagcttgtatgtcttttggggtggatgcaggaagtggaccgggattagtttttgtgacactgccaaatatttttaatgttatggaaaatggtcaaatttggggtaccttgttttttgtttttatgaattttgcggctctctctacgattattgccgtatttgaaaatattgtttcattttcaatggatctattaaattggtcaaggaagaaaagtgtcattttaaattttattattattgtttttggtagtattccttgtgcagttggatatagtgttttatccggatttcagccatttggaccggagagtgcagttttagatttattagactttttagtttctaatgtaattatgccattaggatcacttgtatttttgtttttctgtactcggcgtctaggttggggttggaagaagtttatgaccgaggctaatgccggtgagggcttgcattttcctgaaaaagccaaattttacattagttggattctccccctaattgttatttttatttttctatttggattatgggagaaactattcgcataaagataataatgggcaacagttgcatctgttgcttttttgatgtggtgaaggtgagatatttttttgttaagacaaattaataattaaataatctaataatatgataaaatagtcttatagtaatggcattaacttagggtttagtttagatattgtagtagaaatataaggagagggactatgaatgaaaaattagaactattgattaatgaagtaaaaaaggctgtattaggaaaagatgatgttttaaaaaaagtagttattgctctattagctaatggacatattctacttgaagatattcctggggtcgggaaaactaatttagcggttgctttaacaaaggcaatacagttagattatcagcgggttcaattaacctctgatgttttaccaagtgatttattagggtattctgtttatgattttgaaacaaaagaaatgacttttaaaaaaggaccgctatttacaaatatctttttggctgatgaaattaatcggacgtcaagtaaaacacaatcagcactattgcaggttatggaagaaggaatgattagtgttgatgggttaacttatccaactgctaagccgtttattgttattgcaacacaaaatccgtttggaagtgctggaacacaaatgttaccagattctcagttggatcgttttatgatgcgtttatcattaggttatcctgatgaaatgagtgagattgaaattataaatcgaaaaaaaagtggaaatccaattaattcaatcaacccagttttatcgcctcaggaattgctcatgatgcaagaagcagttactaaaattcatttagatgaaagtttagtgaaatatattgttcaaatcgttcaacagacaagaattcatgaaaaaattgaattaggggcttctcctcgtgcttcgattgcattgatgaaagcggctcaagctagtgcatatttaaatggtcgggactatgttattgttgaagatattaacgaaaacttatatgaaaccctaaatcatcggattttcttaatgccaagtgttaaaaagaatcgtgaaaattttcaaataattatggaagatatcatgatgaagattgcaccaattgcatataagtagttatgtttcgctatcgtcttgcttatttgttattaattggatttggggtatttttctatattgcttttgttggatatttttcatattattttcttttattgattctgattttaccagttttatcacttttttatttagttatgagttttaaatttactaagctggattttgctattttgaatcaaaaagttattcaagatgactttgtaaagattaaaataattaaggataatttagggcttggagcaataaggtttgttgttgaggatcaaaagtatttgatcaagggaaatcaagacggattaactttagtatttaaacattgtgggggaagaaattttattattaatacatactaccaatacgattgtctaaatctattttgcataaaaaagagatgccattatgagataccaattactatttatccaaagagggtagaattagatttcaaagagtacgcacatcaactaccacgagttggtgacgaagtttatgctgtgaatcgtaaaggagatgatcctacagaaatatatgatattcacaaatatcaagagggggatcagttgaaaaatattcactggaaacttagtgcccgttatcaagatattttagttaaagataatgcgatgttagtaggtgaagtaattaatctgtatgttagttttgatgacaatgatgatcataatgatttagtttttggttatcttgataccttttgtggttttttattaaaacgacaaattggctttctattatcaaataaggaaattaaaagtattcaagaatatgacgaaatgtttaaatatttgttatggaataaagagtatcagtcagatatttctaaacataattatgagtttgttattagctataatggaatcatgaaagtggaaggtggccgctgatgaagttattaatttatttattaggaattattggttcagtaggctcgttagtttattcttttaattttagttcgaacaatcattttatttttatttcttgtattatagtaggtttgttaatatatttgggatttaattatattcaaggtaaaaagaagtttgttatcgggagtattattgctgatggaatcttattattgattcctagtacgatggattgtttaacatacataacttcaattattatttataagtatcgtgaagtttctgtatatgattttaattttgaaagtacgtatattttttatgatgatccccaaatttgtatcttagcttttttgctgatttttatcccattatttttatcagctgtaattgcaattgataaacaaaaatatacattagctattttggctttattaccaggtgtttttattgaattattatttacgattacaccaccatggtattttctagcatgttatgttttatatgttttgattttattgattggtgctttgcaaaaaggggctatattaaaaataccaatgattatcattagtgtagttgccatggcaataacatatatatcatttccaataagtacatatcgtccttcaaagtatagtttgtttgataatgccagaacaccaatttcaactcctggaaatataaaagaggaatacaatgtcaatagccaaggggatcgtcattatcgtaactcattagattttacaattgctggtgaagtgactttaaataatttcaagattcgaggaattgcttatgacttgtatgaagatggtaaatgggggacttctcatagtcgcgttgaaacagaatggtttaaaaataacctagagaagattgcaaatattacaaagacttctcgtcaagttattgaagttaatcaaatcagtggttatagtcaacgtaattatacaccatactttatcattaatgacgatatgacatattatggtgaccactatgagggtaaaaaccctcaaacatatgagatgattatacctaatgatgattttaatgctctattatcaacgatcgattataaagccaaaggagaattattaaaggaaatagccgagcgtaatggaacacaggactactacgatgaatattttggacaagggaatgaagatgatgaaaaattaacatcagttcctgaggaaacaaaatcgattattgagaattttttaaagcagcataatgttattgataatggtaatattttcaattatattacacagtgtacaaatgctttagcggctaatacttcttataccttgagaccgggaaatacacctgataatgtggatgttgttgattattttttaaatactaataagaaagggtattgtgttcactatgcttcaacattagcattaatgttaagaagtaggggatatcccgcacgttttgttgttggctatcaagtgccgggaagtaagaacaatgctggtaaattgatagttagggatagtaatgctcatgcttgggttgaaatttatgatgaatatttgggctggataccaattgaagcgactccaacaagtagtgaaaatccgaatacaccaactgatacaattactcctgcacctaaccaaggtgataaaacaccacagccagtggagccagaaaaaccgaatattcaacaaatttctcaaaatgatagttttcaaattcctgtttatatttattatttagcaggagggatgatctttatctttatagttttatttcaagcaagaattcgtaaaaaacgaatgtttaaaggagctgctaatagtaatcaaaaagtctgttattattattactatttaactaaattgaaaattaattgtgatgagataaagacaataattgataaagctcgtttttcacaacatcaaatatctattgaagaacttgaaatagtagagcagttttatcaagataaaacaaatgcatattttaaacaagcaaatttgttcaaaaaaatctatttacgttatttaatagccgttttatagagcaaagcacgcgaattaattgcgtgcttttgctataattgaattaaggagataggaaaatggctaaattgattaaagaaactactaaaagtgaacgagaaaactatcttaacaagctttttgcatgtaaaaatggggactgtgaaaattgtggagtttgtaagatttttgcaggtacttcaccgcaggaagtttattatgattatataataggaaaacgtgaatttttggagattagtcaaacttttaatagtcgcaaataaaatacagtgcttattaactgattgtaagttgctaaaacactgtatttttatatgcaatccaaataagttattaaagcttgaagttttctagtttcgttatttctaacggaataagggaataatattcatgatctgatccatattctgaagacttttttgttctaataatatattttttctaattgtaatagcactgcccgttagagctttttgtaattataggttaattgctatttggtagaatatttactgaatagtgatgacagatatcgaaggcattataatagtataggtgtaaatctatactgacaaaagtcttagatagtaaatgtgattgaaataattaagctgatctttaaactgtttaagtcgattttttatcatatttgatacatagactttaataaattatattttaatcaactatttcattaaatttttatcttattcttgatttattaaaaatacttttaaaagtctatttaaaatattctcttgagatgtttttaggaaaggaatttaagtttaattcttttattatctttttaaagccagtcttcttttaggaaataaaaaaggtttacatcaattcaaatgattaatgaattagagaaactatatcagattaaaactaataattagtctgcttttgcattcaatcgtattgacaaagagaaatatgtgtgatagattttattcatagataaacttgtgattgggagataaaacatcgaacgcgcttgtagagagtctagggtggtggaagctagatagagatgcgactttggtaaatggacccatgaaggcaaaggggaaagaagtaatttgagtatcttttgacgttagcttacgttacaaagcaaaaatgtgatagcatttgacaaagaccataaggtggtatagcagattttaacatctgtccttttaggacaggtgttttttgtttaaatgtgatttcgaaaggggaagaaaaatgagattagataagcgatggtgtagctctttataatttaaaagataaaaactataaagaaaaaggggaacataaaaatgagaattaataaactatttaaattaatggcagtatcagctttaacaatgacagctttaacaggatgcggaaatagcagtagtaatggtgatgtaaaagaggtagcgattattcaatatgttgaacatacatcattaaatacaattaaagatgcttttgatgaacagatggaggctttgggatataaagaaggtgaaaatattaagtatacttttaaaaatgctcaaggagatatgaacacagctccgtcgattattcaagattttaaatctagtaaaaaagattgtgtagttgcaatcgcaactcctgtagctcaaacagcagctgaaatgtcaactgatacaccagttgtttttgcagcggtaactgatccaattaaagctggtttaactacatctcttgaaaaaccagataaaaatattacgggaacgagtgatgagattcaagttgaaatgattttagaaagagctttacaagttaatccggatttgaaaaaaataggagtcatttataataaaggtgaagtaaattcagttactaatattgctaaagcaaaagctttttgtgatgataaaggaattgaaatgattgaaacaactgttactggagtaaatgaagtgcaaagtgcaattgatgtattaactagtaaatgtgatgcagtctttgctccaaatgataatactgtagcaaatgcaatggatatggtaggacctgcttgtgctaaagcaaaagtacctttatatgtaggcgctgattcaatggttcaagatggtggttttttaagtgttggaattaattacgaagatcttggaaaagaaactgcaaatatggttgataaaatcttaaaaggtgaaaaagtggaaaatattccagttaaagtatttaaagaaaatttaagtgtttatgtaaatacaaaagtattaaaacaattaggtattactttgcctaatgaaattaaaaatgataaagcatatgtagaaataaaggagtagttttatgaatcagacggttattttaggagcactggagttaggaggaatttttgccattctctcacttggtttatatatcagttataaagtgttaaatttgccagatttaacggttgatggaagtttcgctttgggatgtgctgttagcgggatgtttacgattaattcaatgccatatgtaggattaataggttcatttgtgattggtgcagcagctggggtagttactggtctattaattacaaaattcaaaattatgccgcttttatctgggattttaacaatgactggattatattcaattaatttagcaattatgaatgatactcctaatttatcactgtttggtaataatactatttttagcagttttactgcatttgatccttatgggaaaattattttaatatatttgattgtaattgttatttgtgtgattttagattttttcttaagaactcagctaggattatcacttagagcctgtggtgataatgaagatatggttcgagcaagctctattgatactgataaaatgaagattttaggtttagcattagcaaatggtttagtcgctatgagtggtgctgtatttgcccaacatcaaagctttgcagatattagcagtggaacaggaatgatggtaattggcttagctagtattattgtcggaacaacatttataaagaaagaaaaaattatttttcagttagttgcagttgtatttggagcaattttctatcgtgcagtcctaacagttgctctacagctgggacttccttcaggatatttaaagctgttatcagcagttcttgttattgtggcaattgcttcaactaatggagcatttagaagtaagaaaagggggcgcaattaatgttagaattaaaggatgtatcagttgtttttaatgaaggtacagttaatgaaaaagtcgcccttaataatattaatcttgcacttgataaaggggattttgttacaatcattggaagtaatggtgctggtaaatcaactttatttcaagctatttctggagcagttgatacaaaacgaggaaatattattttaaatggtcgtgatattacttttgagcctgagtacaagcgctcaaaagggattggaagattgtttcaagatcctttaaagggtacagccccaaatatgacaattgaagaaaatcttcatttgtcaaatcaaagaggtaaacattttagtttaagtctaatgtctcatcgtcatcgtgaagagtttaaaaaggcactgatggaattagagttaggtttggaagaacgattagattctaaagttggattgttgtctggaggacagcgacaagcattgacgttattaatggcaactttagtaactccagatttattgttattggacgagcatacagctgctttagatccaaaaacggcattaaaggttttagaattatcacaaaaaattgttgaagagcatcagattactacactgatgattactcataatatggaggatgccttgaaatatggtaataaaacaatgattatgaaagatggacaaatcattgcaatgattgaaggcaaagaaagagaagaaatgaccgtagagggcttgattcatttgtattctacttcttctcaagaatatacggatcgcgtattattgaaataaagcaccgttatataggtgttttatttttaaataaattataaatataagaaataaaggtataattttaaagaattttctttaagttatacctttgattgtaaatatattaagcttattaagttatcgatcgtcattaggagacaataagtaaaagaaaaaattaaaagtcctcaatcgactctaaatataattatattggaattgattatttttttgatttccaatattcagttattggggcagctggattttcttcagtccaaaaggcttcgtgtctttcaaaataaccaataaccgttccagaagcatttcttactggtacaaagaattcccgctctccagtttttccattaagaacttcaaacatctcattttcaccagcatcagctctatttaaaaaattttctattttttctttttaattttcattatgacaattaaaaaggctgttaccgattttaactctattgccatatctttgcttagcagttttattcatatattgaacgatatggtttctatcgacaaatacaatttcataagcataagcgtctaaaataccaaataatatttcttttgttaattccatttttatcaccccgctattatatctacttatattttatcaaataattaatttaatcatagaaaaatattaatatattttttatttaatgcatcatattttagtattttgctttaagatgagactattaaattcaatattttttatttatatgaataaaataatcatgaatgtttaaaataatttgattgaccacatgacacatgattaaaaatatttttataaaaaatagaaaatttcattttagctccttaaaaaacggagttaaaaacctttgatataactcatattatctttttctttggtatcatatccttgaggtgataactatgtctcatataaaacgtaaacctaaaaaggattctatgatcgatcttattaataaatacagtcatgatcatttagcttgtgttcaatatttctttaatattaaatggcctactggtttctattgcgataaatgtggctgtactcattactacttcaatgaaaaaagaaccctttttgagtgtgctgattgcggtcatcaacactatttatttgctggtactattttccaggataataaacttcctttgttcaaactaatcttaggattgtaccttttcttttctgcaaataaaggctgttcagcggtagaactcgcttctgaattagatgtcaattataagactgcattaaaattatgcaaaaaatgcagagttttaatgactttatccaacagtgaaagaatacttgatagtatgttttatgaagcagatactctttacattggagctaaaacatcaaataaaccgaggaatggcaactgaacagcagccagttttcatgattttatcaacagataaagaaaataaataccctagatttatcaaattagcagttatacccgtagataacaaagaattcataaacaaatttttccatatgaaggcaaaagcatcaaaggaaagaatattaaatacagatggaaaaacaacattttcagatttatcaaaagacataacattaaaatcagagaaaataaactatgatgaagataatcaccgattaaaatggctaaatatcatatcaggaaatattaagaacaatataacaggaatatatcatggtgtgaccaaaggttcattaccgttatttttgcatgaacaggaatggcgattcaatcatagaaacacaggtaaatcaatcatggaaaaagtaagtaaatatataacaaaatcattcccaatcaatatggagaaactatcacaaattttggatttatccaagtcttatttttcaccatgtgtctgatggtcaatcaaataaaataataaaaaatcgtagagtaaagtactctacgatttataaaaaaaagtgcgtaaggatcagcacttttttatttggtcataattaatgacaagtaatattttgatttgagaatttatcgatccagcttttttttagatcaaacgaagaatgaacataacgatctaaagtaatttgtgaaccgctatgacctaaaatttcactaagacatttaatttcaaaaccaccttcaatgcacatagtcgcaaaggtgtgtcttagcatatgaaaattagcttttttaattccggcagttttaatatagtttctaaattttcgttctaaagatcgtggttcaacaaacctatctgctctacctgttaataaataacaatcatcactactgtgaaatattctaaatagcgaaataagattaccagggataggaatctttctacttgaagtagaactttttggtgcttcctcgattattattgtttttggggaatcactataaatatttttaattctttgcattgttttattgacaaatatgtagttttcatttaaagaaatatctttccatttcaaagcgcataattcaccgattctaagtccagttgcatagctactaaaaccccaaatttacatggatcaatatcttttagtaaaatttgatttaaattcataaattcttctttagatagtactttttctttttctctttgttttttaggataaattattttagtatttatattaatattatgttcggattcaatatatcttataatagatttaaacaaagaaagaatatcttttactgtcttaggtgacagtggtttaccattttttccttcttttaataatgaagcagtaaataattcaatgtgttttgtacttaattgatctactcttatttccttaaaataaggtaataaataattataaattgtattataatatttaacataggtgggaactttgaatttaatccgatatacatttaaccattcaactatataatatcctaagacctgataattaatattttgtttatttactttttctttgtttaaagaattacaaatattatttcttttttgttttacttcagtatatgtgctagcataaacacttccatatagttttttattattagtacttattgctttaacatatcgggcttcccatctgccatcttttcttctaaaaatattttctcctcttcttggcatatattatactcttctttcttttagattcttttgaccaaaaaaatgactagaaatagtacttaaatctatttaaaacattaattatttggtaaataaatttataatttagttttatcggtgttttttgacaatttatcctatcattttttgttcgataatgataaaatgcttacgtaactatagaatttttttgttcgtagagtactttaatataagacagttttgtgaccaaaagttagtttatattgtaaggaggattatgatgaattggtatattatttttgcaaatgataataagatcaatgatcttttactttattttaataatcatcctgagatgactgcttttgtaccaaaaattgaaaagttaatgaaaaaagatggaaagaaggtatttgcagaagtgccgatgtttcctaattatatctttattgaaagtgaatttaattcacaggagttttatcagattattgaaagtttagaaaaagatatggattctacgatgagaattatgcaaagtgatgaacaaaaagttttatcattagccaataatgaaaaagaacttttagaatcgttatttaatgatgatcatttaataacccgttcaatgggaactattactgattctaagttaatagttcaaaaaggaccattagttggtaaagaggaaatgattaagaaaattgatcgtcataaaagagttgcttttattggtgatgtttttggtaaaacaatgaaagttcctttggaagttacaagtaaaacataggagttgttatgaaagataactggtatgtattatttgcattagttgcaaaagaaaataagttgtgttcagttctaagaagaaaaggtcttgatgcttttattccaaagattgaatactatcgtcgagatattaaaggaaatacattaaaaatgttatttccaggatatatttttgttagaagtgaaatgaagcaaagtgattttgataatctgttatatgaattaggggaacagagagatggtttgattaagcagcttaaagatgatggagttacagctttaagagatgaagaaatcgagatgtttaataaactactcaatagcgaaggtatcttagaaatgtcccaagcatttatagaagataataaagctaaagttatatatggaccattaattcattatcaagatcatattgttaagattgataagcacaacagaatagcggttttagatatcgagtttttaaatcgacatatcttagctgggcttgaaataaaaagtaaaatttaataaatgtagctggtttaccgcacattttaataatttgaatatagtttcttctacttggggtaggggggaactatattctttttttgtacaatttaactgcataaagcagttttttattatggaggggaaattaatattaagattaggactttttctataaagagttcttttttggttactcaaattattttgatgagggagatgaaaaaaacatgaaatttaaaccttttgacaataaggtatggttatcttcaccaacaatgcatggtgaagaattagaatatgtaaaagaggcttatgaaactaactggatgtctactgttggggtaaatatcaatgaagtagaaaaacttacctgtgaaaagattggaagtaaatatgcagttgctttatcagcggggactgctgcacttcatttagccatgaaactggcgggtatcaaagtatatggtatgccaaaggttggatatggtgcgttagaaggaaagaaagtattctgctctgatatgacatttgctgcaactgttaatccagtagtttatgagggtggtataccagtgtttattgatagtgaatatgaaacttggaatatggatccaaaagcgttagaaaaagcatttgaaatttattcagaagtcaaagtagttgttattgcaaatttatatggaacgccaagtaagttagatgaaattaaagatatttgtgataagcataatgcagtattaattgaagatgcagccgaatcattaggggctacatataaagggcaacaaacaggtacatttggaaaatataatattatcagctttaatggtaataaaattattacgggatcagcaggtggtatgttattaactgatgatttagaagcggcaaacaaagtaaggaaatggtcaacacagtcaagggaaaatgcgccatggtatcagcatgaagaaattggttataactatcgaatgtcaaatgtaatagcaggtgttgttagagggcaatataagtatcttgatgaacacattgcacaaaaaaaagcgatctatgaaagatataaagaaggtttaaaagatttaccggtaaaaatgaatccatatattgaagatattatggagccaaacttttggttgagttgtttattaatcaacaaggaagcgatgtgtaagcaagtaagcaatgatagtggtgtgttatatattagtgagccaggtaaaagttgtccaactgaaatattagaggcgattacatctattaatgctgaaggacgtccgatttggaaaccaatgcatatgcagccgatttatcgtttgaatccatttgttgtcagagatggaaatggacgtgccagatcaaatgcttacattgcaggtggtgtagctgatgtaggaatggatatttttacaagaggcttatgtctgccgagtgataataaaatgatagtagagcagcaggatagaattattgaagtgattagagcttgctttgaatagaaatatattgtgggagagattattgtgtcaaagaaaaaaatagttggaattatagcatcatctattattggtggaacagcgatagtaacttggattatgaaaaagaaggcgaaaaaaacaacttataaagctgaaaatatagaagcgattccgacacgtaaaatgggattttatgaaaaatatgttaaaagagcgatagatgttgtttgtgcgtctgtagcaattatatgttttagtccgttgtatataggtgttgcaattcttgtcaaattcaaactgggaagcccagtgttgttcacgcaggatcgtccagggttgattggagaagatggaaaagaaactatttttaaaatgtacaaatttcgtactatgacagacgaaagagatgaaaacggagagcttttaccagatgaagtacgtttaacttcatttggtaagtggcttagaagtacaagtcttgacgaacttccagaggcttttaatattttaaatgggacactttcgatttgcggaccacgtccgcagttggtcagagatcttacatttatgacaaaggaacaacgtatgcgtcatactgcaaaacctgggttgagtggcttagctcaggtaaatggacgaaatgcgattaagtgggaagataaattgaactgggatttgaagtatatagaaaatgtgacattgttaaaagattttagcattatattaaaaactgtaaaaactgcgtttattaagcaagaaggaattacagatggagatatggcaacagcagaagatttaggtgattatttgctaaaaagtggaaaagtagatcgagaagaatatattgaaaaacatacaaaagcgaaaaaaatactaaaaggagaagtggatgtggaagacaatattgaaatagataaaattcatcatgtacctttttcagtagctatttcagtatataagagtgataatcctattttttttgatagggcacttaatagtattaccgaaaatcaaacaattacaccaaatgaaattgtactggttgttgacggttcagtaagtgattcgctaaatgaggttataagtaagtatgaaaataaatatgacattttcaagattattcgtttgaaaaaaaatggtggattaggaaatgcactaaaaattgcagttgaaaatgcaacatttgaattgattgcacgaatggatagtgatgacgtttctttgcctacccgttttgaagaacaattaagatattttcaagtaaatcctgaaatagatattgtaggtggaaatattacagaatttatcggagaagaaaataatattattggtcaacgtttagttccagtatctaatgaagcaataagagaatatatgaaagaacgttgtgcaatgaaccatgtatctgtcatgtataaaaaaacagcagtacaaaatgcaggaggatatcaggattggttttggaatgaagattattatttgtggattcgtatgtggctaaatggagctatatttgcaaatacaggaagtgtgttggttaacgttcgtgttggagaggaaatgtatcagaggcgtggaggctcaaagtattttgagagtgaaaaaggacttcaggattatatgttgaagaataagatgattaatcattcgacatatataaaaaatgtagctaagagattgattattcaaaaattaatgcctaacaagctaagaggttgggtatttagaacatttgcgaggaaaaaagtatcatgaattatgtagaaggtcttgtcagtgttattatgccgacttacaaacgttcagaaaaattactcagagcaatagacagtgtattgaatcaaacatataaaaatttagaattgctactagtaaatgataatgagccatttgatgaatatacggaattgttgaaaaaaagagtagagaaatattcgaatgatgaaagattccgtctgattcttcaggataagcatattaatggcgcagttgcaagaaatgtaggtattcgccaggcaagaggacagtatattgcttttttggatgatgatgactggtgggaactgaataaactggaagaacaggtaaaagaactaaagtctcttgatgatagttggggagcggtgtcatgcaagtttacattgtatgatcagaatggaaatgttataggaaaaacaaagaaatatagagacggatatatttataaagatatattaaatcttatgtcagatgttgcaactggcacattgcttatgagacatgactattttgatacaactagatattttgatgaaaacttgttgagacatcaagatttgcagcttttagtagactttacatcaaaatataaattaaaagaagtaaatcaatatttgcattgtgtggacgtttcagatacacaaaacagaccagacgctcaaaagttaatacaatataaaaaagctttttttagatctataaagcctgtgatggattcgctaagcgaaaaagaaagaaaatgtatttacgcaatgcataagtatgaattgggctatgtatgcctgaagaatggagaaaaatgtcaggggttagggtattgtaaagcagtattgaaaagtccgaaagcgtgtggattagcactaaagaaaacctttctgaaaattattcagatatgtaaaagataataaaaagtagtgtatagtaggagcattatgaaaaatataggatattttggcgcaaagcttttgtataaactaaaaaggaatgataaggaagtaattagtagatactttagaagttctgggatgaaaattgggggagggtgtaatatatgttgcaatattatgacttccgaaccatatttaatctccataggggataatgttacaattgcaggaaatgtgacttttgttacacatgataatagcatatcgaaaatagatacaagatatgccaatttatttgggtatgttgaaattggaaataattgtttcctagggcaaaatgtaacagtgctgtatggggtaacattagctaataatataattgttgcgagtggaagtgtagtgtgtaacagttttaatgaagaaaatataattataggtggaaatcctgcaaaaaaataggaaattggaatagtttagaagttaaaggaaaatgttatgctatgaaaaaaagagaagcatttgaagcagcggaaaataaagaatataggaaatttataaaaaggaaaaaaatgtaatggaagaattagtaagtattgttgtgcctgtgtataacatgggaaatagtatagagatatgtgtcaattcattattaaagcaggattatgctaatattgaaatattattagttgatgatgggtcaaaagataatagtcttgagaaatgtaataaactaaaagataaagataatagaattcgtgtatatcatacagaaaatagaggatcagggccggcacgaaatacaggaattgaaaatgcaaaaggacagtatatatattttccagatgctgatgatcaacttgaagaaaatgcaatatctatgttagtagctggaatgcaaaaaggaaaatatgatttagttgtttttggatataaaagtttagataaaaatggtaatacagtacttttgaaacagtatcctgaaatggaaaagaagggggaggatgttcggcaagattattccaattatgttgcctcaacaagaaagtacggaattcaaggagcaccatggaataaattttttgatttgtctctaataaaaatgcattctattgagtatccacctttaagacgccaccaagatgagggatttataagtcgatatatgtgtttttgcaataatatacattttattcaaccaattctatatattcataatttgaatgatttgaaaaaagagtgggataagtatccagtggattatattgatgctgtaatgggattatataatactaaaaaagaaacgatattgacttggaataaaaaagataagaaaacgaaaacgataattgaacatgaatacatttgtaatgtgataaaatcacttgagatgtcatactctcctaaaatgcatatgaagtcaattgacagaattccatggataagaaagcaagtagaaaaagcggaggttttagatattgatattccaaatacattaggacggtaccaacgtatagtactgatgttaataagaaaaaatcatataaagatggctttaataattatgagatttaaaatagaggttgaaaaaagaggggcacttaagttattgaggaggtagttaatggacgtattaacatatgatgattataaacaaaaaattcatttagataacttaggttttattttgttgatgccgatattaattgattttttgagcgtcattgttcaacaatttggaatgtccggttcatcggttattacaatggcactttatggattgtcgttaattgttattattattaagcttattaaaattgtgacagtacatgaaatattaaatgacataatactgtattttttagtgttatttccttttggagtgaattatttctggtttgaaaacactagagcagaattaatatcacaagaaatgctaatagtgtatttattttttatcttgttggctatattttcgattagaaaaataagacggtgggatcttttctttgaggctttgattaaaccgggaaagatagcgatatttttagctgtatttatattattatttctggattatgaaaagtatttagtatatatgggattttcatatgcgttacttccatttgtatgtaatttttatagaactgcacgtataaaaaaagaatttaaggaaaagttaatagcttgcattttttttgctgctggaatggtgtcgattttagtttttggtgcacgtgctgctgttggatttgcatttgtgtatattattgtttttgaaatcttaagaaatgatttaacattatcattaaaaattattagtttaataattcttcttttaattgtttggataataagtagtaatataaacgcgattgcagaaatgcttgtgaagatggatgcgtttaaagattcttatcttttaaagaatctattatcaggacaacttttagaatcaaataccagagatattctttaccaagcttgtttgaacagaatgtcaaccatgggattagaaataagtggattttttggtgatagacagtattgtgcaggattcgcttatcctcataatatattttatgaattaataatgagttttggatggattattggatctatattgataggcacatatgcattactattattaaagggaattttaacttcgaaaccagaaaaaagagaagtgatgatttttattataatatccatgttggcacgatatgttatttctggaagttacttagttgagggtaagttctgggtagcaacagtattggtaatatcaatatcattaagaaaagacaagaggtttgacaatgaagaataaatcaaaaacagtatatacaaatttaatgtggagattgcttgagcgatttggggcgcaaggagtaactcttgttgtttctttaattttagcaaggttattagacccagaagcatatggaacagttgcattaataacaatttttacagcagttttgaatgtttttgtggacagtgggttagcgaattcattaatacaaaagaaaaatgcagatgatgtagatttctcatcagtattttattttaatgttttgatatgttgtttgttatacataataatgttcgtatcagcaccagctatttcaagattttataataagccagagattgttccgatgattagagtgcttagtttgaccttaattatttctggtataaaaaatgttcaacaggcttatgtttccaaaaatatgatgtttaaaaagttctttttttccacattaggtggcacattaactgcaagtattattggaattgccttagctatattgggaaagggagcgtgggcactcattattcagaatataactaatttattgatggatacaataatactttggtttactgtaaaatggagaccaaaacttcttttttcttggaaacgattaaaagggttgttgtcttatggatataaattattgttagtatctttaattaataatatatataatgaatgccgacagttaataataggaaaaatgtattcatcatcagatcttgcctgctataatcagggaaatcgtttccctcagattatagttcaaaatttgaatacagcaatcgataatgttgttttttcggctatgtcagcagctcaagatgaaattactgaagtaagaaacatgacacggcgttcgatacgaactggaagttttattttggctcctttaatggtgggcatggcgtgtgtaagcaaatcagttgtcttgttaatacttacagataaatggatagcatgtgtaccatatttgcagatgttttgcattatgtatttgtttgcaccaatccaaacagcaaatctaaatgctataaaagccataggtaaaagtggagtatttttaataattgacatactggaaattgttataggcttagttggattacttgtgtcaatgtggtttggtccaatatatattgctttttctatgttggtttgcacgatattaaatttatttattaattcttttccgaataaaaaatatttaaattatggaacacgagatcaattaagagatttattccccaatatattattagcaggagttatggggattgtggtatgtagtattaattggttagaattatcacctataattagtttgtttatacagattccgttgggaggaataatttatattgcgggagctgctatattcaagattgaatcttttgattattgctgtggaataattagaggattgttgaataagaagaaagaataaaggattagatatgagaaataataaaaaattctactataagtatatacatttaatgtatggacatgatacaaaatttagtaagttgctgttagattttatttcaaatcctgaaaatggatttgaaataaatcagcatttatttgttacaccgtataaaaatgtttttgatgatttgaaacagtattctaatgtgttattagatgaatcgaataaaaatttatataaagtatattataaacattgccatctgattatttcacatagcggtgaagaattgtataggattttattaactcctaagaagataaaaaataaagttgtttatagatattggggaggtatgagaatactgcaatatgatgaaaattcgaaaacatttggagaaagtttaaaactcaaagtaaaaaaatatatattaaaaaagagtttttctgaatttgctgcaataggaattgcgaatataacagatattattgatttatccagaatattaaaaaaggatacaaagtattatcgtttatcatatgcatctaatgaatattatgatacagtaaacaaacttaaacaaaagttagacatagaaaatgatattaataaaagatataagaaaagagtattattaggtcatagaggtacagaagaaaataatcatatagagattttaaaacggctgagtaaatataattcagaaaactttgatatatttatccctttatcatatggagaaaaaaaatacattcaaaatgtagaaaattatgtgaaagaaaattctaagggaaatatcgtgattataaagcaattcatgaaattctcagaatatgcggagtttctgtcgacaatagatattgcgatttttgatggatatacatcttatgcattaggaaatttagggataatattattttttaataaaactgtatatttaaacgaaaatggtgtaattgcgaaggcacttgaaagtgaaaataatgattataaaaaaatttcggatataggaaagatttcttttgaagaattttcaaagccaatgaaatatccggcaaattatacttctgatttatgtattatttcgacagaagaaagaataaagaattggaataagttgttagcagattttagtgataaataaagagagggaaatacatatgaataatatactggttacaagatcttctatgccgccttttgatgaatattgtgatgaaatcaaagatatttgggatagtcattggcttactaatatggggagcaaacacaaagagttgcagaaagagctagagaaatatctggacattccacatgtagcattgtatacaaatgggcatctagcattggaaaatgcgattgcggcactaaatcttccgaaaggcggggaagtaattactactccgtttacctttgcatcaacgacacacgccattgtaagaaatggattagtccctgttttttgtgatattaaagaagatgactatacgattgatacgcagaaacttgaaaagttgattacagataatactgttgccattgttccggtacatgtctatggcaatatgtgtgatgtggaagaaatagaccgtattgctaaaaaatatggcttaaaagtcatctatgatgctgcacacgcttttgctgtaaaatataaagggatatcctcagcttgttttggcgaagcttctatgtttagcttccatgctacaaaggtgtttaatactattgagggtggctgtgtgtgctttaagaatgatgcgtgggtgcagcttttgaacgatatgaaaaattttggtattcatggaccagaggctgtggagtttgttggtggaaatgcaaagatgaatgaatttcaggcggcgatgggaatttgtaacctgaaacatttgaataccgaaattgagaagcgtaagaaaatagtagaacactacagaagtcggttggagggggtggaaggtatcaaactttctactatccagaaggatgtggaaagtaactatgcctactttccagttgtttttgatggttataagtacactagaaatgaagtatttgaaaaactggcggaagttggtattggagcaagaaaatatttctatccgttaacgaatagttttgagtgttatcgtaactatccgactgcaggtacggaaaaaacaccgattgcacaacacatagcgttgagggttttgacacttcctttgtatgcggatttggctttggaagaagtggatagaatttgtgatgtaatttggaggtaatgtaataagaatgaatgttatgctaacatctgtaggtagacgtgcctatttggttaaatattttaaagaagtactcggaaatgatggaaaagtttttgtttgtaattcagatgataaatctattacattcaaatatgcagatgaaaaggttatttcgccattgatttacgatagcaactatattctgtttttgttggagtattgtaaagaaaatagaattgatattgttatttcgctatttgatattgatcttcttatgctggcaaagcataaaaagcagtttgagaaaatcggtactaaggtaattgtatcagatccaatcattatagaagtatgcaatgacaagtggaaaacttataaatttctgatagataatggttttcatgcgcctatgtcttttttggatatgaatgaggttattgaaaagatttcggagagaaaattgtcgtatccggttgtagtgaaaccacgatatggatgtggttctatctcagttgcaattgcttatgacgaagaagatctgcgctatttgacaaagaaagcaaatgaagatatagcaaattcatatttaaaatatgagtctgcagtgactaatgataaggtcatttatcaggaatgcctaataggtcaggaatatggagcagatataatcaatgatctgaacggagaaacacagaatgtgattataagaaagaagttggccatgcgatccggagaaaccgatattgcacaattagttgatgaaccaagcatcaaggagacattagttcgtctgggaaaaattacaaaacacattgctaatatggattgtgatatattcttggtaaatggtgttccatatgttttggaaatgaacgctagatttggtggcggatatccgttttcgcacatgggcggttgtaatttgccgaaagcaattgttgaatgggccaagggtgagcctgtagataaagaaaccatctctgctagaacaggtattacaggatataaagaaatttacattacagaaatataaaatggaaggggataagtatgcaggatgagtttaagctgatgcaatataaaacaccggttgttcaaattccagataaagataataagatttatatcaagagagatgatttgcttccattttcgtttggtggaaataaagtgagaatcgctttggaatttattgcagatatgaaaaatcaaggcaaggattgtattgtaggatatggaaattcaaggtctaatttgagtagagcattggcaaatctctgctatcagcttgaaattccatgtcatatcatatctccagcagatgaagatggcacacacattgatacatataacagtaagatggcattggcgtgtaatgctgagttccattattgtcgaaaaacaaatgtaaaagcatctgtcgaacgagtgcttaaggaactacgagataaaggcctaaatccatattatatttatggcgattcaacgggaaaaggaaacgagcacataccgctgttagcgtatgtgaaagtttatgaagatataaaggcacaatttgattatatttttttagcgacaggaacgggtatgactcaagggggactccttgcaggcaaggcaatacatggaggggacgagaaaatcgttggtatttcggttgcaagaagttctatgcaggaaacgagtgttttaaagaattcattagagtgcttcagtactagagttcagaaaattgattacggcgaaataaatgtgcaggacgaatatttgtgcaatggttatggcacgtataatcgtcagattgaaaagaccattcatcaacaattgacttgtaatggaatgccgctagatccaacatatacaggtaaggcattctggggaatgcgagagtatatcaagaaaaataaaatagttggtaagaaaatactctttatccatacgggcggaacccccctgtttttcgattatatgaatggaattagactgactgaagcttctaataaagaagccgtagaagaagcggttatacgtttggagaagagattggtgccatcactgacagacagaaaaattaatatctctcagtattccgaaaaactggcacaatatgggaaggtatggattcattatgatatggggaagcctatatccatcattgcaggatattttaatgatgaaacgacacggacagtctatctgtcgatgcttgcagtggcagaagaatatcaaggaaaaagattggcatcttcgctactatctgaatttgaagattatgcaattaagaataaaatgaattatgtgaaacttgaagtaagaaagcataatttggtagctcgaaaattgtacagcaagttcggatataaagtgattggtgatgcttcggatacttcgtactatatgctaaaaaaactcgaaaatctttcgggggggggcacagaactctatcaatttctgacacgaattgataatcttttcccgatttcgctatcagacaaagaatcactttctgttctttcttcaaaactggaaaaatatggaacgatttcctatgttaaagaacagaatcggattgttgcaatgtgtgcgggatacgcaaatgacctgcaaaatcgacgtggatacatctcggtagtagcggtgctcccagagtattccaataagggatacggaaaagtagctgtacagggctttctaaaaaaagcgaaaagcgcgggaatgttggaagtacatttgtatgcggattcagaaaatagttcagcattacatatgtatgaaaagttgggcttttctgaatggcatattattaatgaatcgagacagaaagataaacatttaataagaaaatttatttaatggatttggaaaatataataaaatgatatgataagaaacactatctattgtagaaaattcttgttatagctgaaatgggaagcacatttcacaagcaacaaattttaaaagtaagtatatgtcaagaaagagacgatttaagaaatatttaaaaactataaatgagtaaacataagatataaatgacaataggagattaaaatgaagatagcagtagcaggaacaggatatgtgggattatctattgccacacttttatctcaaaatcatgaggtaatggcagtagatattattccagagaaagttgagaagattaataaaagaatcagtccgattcatgatgagtatattgagaaatacttaagggaaaaagaactgaatctgacagctacattggatgcagaagcagcatataaagatgcagattttgttgtaattgcagctcctacaaactatgattcaaagaagaacttctttgatactagtgcagtggaagcagtaatcaaattagtcatagaatataacccagaagctgtcatgattattaagagtactatccctgtaggatatactcaaagtattagagaaaaaacaggatctaagaatattatcttctctcctgaatttttaagagaatcaaaagcgttatatgataatctttatccatctagaattattgttggaacagatatgaatgatcctagattagtagaagctgcaaacacttttgcaggtttactacaagaaggcgctattaaagaagatatcgatacattaattatgggatatacagaagcagaggcagttaaactattcgctaatacatatttagctttaagagtgtcatactttaatgaattagatacatatgcagaaatgaaaggattagatacccaaaatattattaatggtgtatgtctagatcctagaattggttctcattataataatccatcatttggatatggtggttattgtttaccaaaggatactaaacaattagtagctaactatcaggatgttcctcaagaaatgatgagtgcgatagttgctagtaatagaaccagaaaagatttcatcgctgatagagtattagaaattgctggagcatatgaagctaatgactcatgggatgaatcaaaagaacataatgtagttattggtgtatatagattaactatgaaatctaatagtgataactttagacaatcatcaattcaaggtgtaatgaaacgtattaaagcaaaaggtgctgaagttattatttatgagccaactttaaaagatggtgaaactttctttggaagtagagtagtaaataatttaaacgaatttaaacaacaatcacaagctattattgctaataggtatgacagctgtttagatgatgtagaagataaagtatatacaagagatttatttagaagagattaatcgttattatgataatatacgcgtgatgaacgaaaagaatatatatagaaagcagttagtccgagtgtaaataattttgtgtaaactgatcctccaatggtagaatgaaattaactaccaaaggaggatttttattatgagtaaaaaagatatagttaaatatataattgatgagtatggtgttacatcacctactgatacaactaatgctttaaaagacttattaggtgaaacattacaagatatgttgaactctgaatttgatgaacatatgggatatgacaagtatgatcaaaaaacagataaaactaattatcgtaatggaacttccaaaaaaacagttaaaacatctcaaggaaatatagatttagatattcctagagatagaaactcatcatttgatccagctattatagaaaaacacaatcgtgatattagtgatgttgataacaaaattatcaacttatatgcccgtggtatgtctacaagagatatcagtgatactgttaaagatatttacggtgtagaagttagtgcagctatgataagtaaaataacagataaaattatccctaaagctttacaatggcaaaacaggccattagatatgtatatccaataggctttattgactgtgttcattttaatgttaaaacagataatatggttaccaaaaaagctgcatatgttgttttaggagttaatgagaatggatataaggaaatatttggtatttggatcggcgaaaacgaaacagctaaattccagctatcagtactaactgatttaaagaatagaggagttaaggatatattgattatttgcagtgatggtctttcaggtattaaacaagcaattgaatcagcattcccaaatacagtacaacaaagatgcatagttcatctaattagaaattcatgtaaatacttgagttataaagacagaaaagaattctgtaaagatctaagaacagtatatacagaatctacaagtgataaagcattagaagcactggataagtgtaagggtaaatggggagataaatatccgtatgcatttaagccatgggaagaaaactggaatgaagtttgcagtatgtttaattatgttccagaactaagaaaaatcatgtacacaacgaatgcaattgaaagtttaaatagtgcatttagaaagtttactaaaataagaacagtattcccaacagatgaaagtttatttaaatctttgtacttagctcaagataaaataacaagtaaatggaatgtcccatatggtaattggggaattatatattctagtcttcaaatcatctttgaagggaggggttaacgagaacatttacaattaaatatattatgatatgatataaaaaagtaactgtatgattactcaatacagttactcatcaaattctatcattggaaacagactttacacaaaataatttacaggctctttaatactcttagtgcgtcatatgctaatattattcaaaaaataattatacgaatattcatgtttatctattatggaataagatgatgaatattgtagcaatcatcttgattgacacaatagatagtattctactttattaggcaattacatagcagtcgctgaaattctataatatctttaattagatagagtgtaaaagaccacaaatttaaattcaccattttatttaacacttaccacatttcttaaactttcctaatatcgtacataaaaacaccttttgactgcaagattagatatgtttatatacttatttgctgatatttgcagcaattagaggctgtatttttatatgtgatatatcatggacttgataatatataatattcagtcaatagagaatattttgttaaaattgtaaagaaataattgaaaataagataaatgtttataataaaagaaaatcaaagttgcaggttgaagttattgtggtgcgatatttataatagaagtttttgttaaagaggtgaaggtagaatgataagaaggcattatttattttatggtcgtgtccaaggtgtagggtttaggtttactacctatcaaaaagcaaaaaatcttggattaactggctgggtttgtaatttatcagatggttctgtagaagcttgtattcaaggtgaggagaagttgattgattatttgatcaatgaattacagcatgatcgttttattagaatagattcaattaagatggaagaaatagcagttctaaaacatgaaacttcatttggaatgaaaaactaaataattttaaaggaccgttggaattgatatatgccaatagtcttttattgtagaagccttcattaaatatacttaatatataataatcactaaaataggatgataataaaacagtttaaatatctagaaaatgaatctaatatagatgttctagtacttaatattgttttgatacccaatctttatatagatgaagtagatattttatttaatatagaagtcaaaaactagatgattttactttaactaataaatttattgaaaatgataagataaagtgaataaaaatatttttaaatgaaagtagagcaaaaaatatgaaaataagatattgtcaaaaagaggatctggaagctatttataaactgatttgtgaattagaggaatgtaatttaaatcatgaacagtttgctctagtatatgaaaataaacttaatgatgaaaagagccactatttagtagctgtatctgatgatatgattgttggatttgtcagtgttaatatcgattatcaattacatcatgagaataaagttgcaacaatcgaagaattagttatagataacagttatcgtggaaatggtataggtagattattagttgattttagtacaaaattagctttggagcatcaatgtgaagtaattgaacttactagtaattttaaacgtatagaagcacatcaattttatcaaaagaatgattttattaaatcatcatacaaattaataaaagttttaaaggatagtgatcaagtagggatataaatatccaatttgggattggaattgtggataattttgttcgtagtaaagtagctttagctaaacaagattataaaaataatcatttaaactaagaagatgttttatttgtcggtgatacaattcatgattatgaaatgtcaaaagtattaggatgcaattgtgttttaattcctcgtggtcatcaaaataagaaaattttaaatttaaatactatgctgatcgataatgatttcaaggaattaatgataaatattacaataatgtaagattttgtaatgtaaatcaatggaataaccaagcagcttaggctatgatagaggtgtaaaataaggaatagagggatgtatatgaaaaaagtaatatcacgtctaattattattcttttcttagctgccttaacctttttaggatattatggctatcgtggctatgtgatgtaccaagatacaatggaagaaaagagtttaacagtgcgagttgaagaattaagaagtaaagataactatgttaaattggagcaaatatcaagtatatatcaagaactagtaatagaaagtgaggataagcgtttttatcaacatggcccagttgattacattggattagctcgagcaatggtaacgaatgtagtgacgatgtcgtttaaagaaggcggtagtacgattactcagcagttagctaaaaatctttgtttatcttttgaaaagagcttagaccggaaaatagctgaagtttttattgctcaaaaattagaagatgattatacgaaagatgaaattcttgaaatgtatttgaatattacatatttaggtgaaggaaattatggaattaaagaagctagtaattattattacaatattgagcctatagaacttaatgaggaacaggcaaaagtattggtaaagacattgaaggcccctagtgtttataatccttctaagttagctgaaaattaaagtgatagtgatgaagtgaattttctatgttgaattagcaatgagggtttgcttcatattgaaatcactttttttattttctaaataaaaaatacttgtcttaaagtgtactttagggtgtatagtgtagttgcgatcatagcatggtctaattagtaaatagatggggattgtgatattattatgtataaaggtgaagagatgagtaagttagataaattaaaagaattattaaaatcttatcaaaaagttgcaattgcctatagtggtggctgcgattcaaattttttatatcaggtagcattacaaaccttaagtaaagaaaatgttctagcagtattatgtgtagggaaaatgatgtccaaggaggacatcgatagtgctagaatgatggctggtaaaggtcaatttatagaagtgccgttagatgtatttacaatcgagcaatttacaaataatcgtaaagatcgatgttatcactgtaaaaaacaagtaatggcaaaagtaattgaagcagctcaaagccatgattttaagataacccttgatggtaaaaatgctgatgatgaaaaagtttatcgccctggaatgaaagcttgcgaagaattgggaattgtatcaccgttagcactagttggtttaacaaaagctgaaataagacagtattcaaaagaattacagattgagacatatgataaaccggcaaatgcttgtttagcttcacgttttccttacgatactcatctcactaaagaaaaattagaagtggtcgatcaagctgaggctttacttcatcaaaaggggatttattacgctcgtgttcgagttcatgataaattagcacggattgaagttgaacgaaacaattttaatctagttaatgatgaagaattaatcttagcaataaaagaacttggatttgattatgtaacattagatttggaaggcataactagtggaagttatgataggtagtgaaatggaagttgtagttattgatggtcaaggtggaggcattggccgaagtgtaattgaggccttaaaaaaagaagttagtggtacttttattattgcggtaggaacaaatagtactgcaaccaataatatgaaaaaaggtggagctgatgctgtcgcaacgggagaaaatgcaattatttataatgctaaaaacgctcagataattattggaccaattggttttgtttttgctaactcgatgtatggtgaagtttcaccagcaatggcggcagcaatcagctgtagtgaagctcaaaaatattttattccagttagtaaatgcactggacatgtcttaggtgttgagccaaaatcaattcaagaatatattagagatttagttaatattttaaaatagatcccaagtacaagaagtactagaagaagcacagtagtgtttgtggaaagggaaattatgaattcagtattaatgcatatggcagatggtttgatttctgttaatattggggttattttcatgataattagttttatcatgatcggtttttcaattaaaaaaattaatcaagaacatgatgatcgaaagattcctttaatgggagtaatgggagcatttattttcgctgctcaaatgatcaattttacgattccgggaacaggaagtagtggtcatatcggtggaggaattttattgtgccttattttaggacaatatcctgcctttttatcattatgttctgttttaattatacaatgcttattttttggtgatggtggtttattggcgttaggatgtaatatttttaacatggggatattaccatgttttgtagcttatccattaattgttaagccactattaaagaaaaatataacttcttcaagagtattactggcaagtattttaggagtagtagtgggattagaaatgggtgcttttgcagtggtcttacaaactcttgcaagtaatattacggaattaccatttacttcatttgttgtattaatgttgccgattcatttagcaattggtctagttgaaggcttaatcacttcaacagttgtcttatatgtattaaaagataaacgtgaaatagttgatcatgcacttaatgacaagcattttggaacattgaatataagaagacaggttgcggtttttgctgttttaacaatcttagttggtggagttctttcattatatgcatcaagcaatcctgatggtttagagtggtctattgaaggagtcacaggaaccgacgaaattgaagcaagcggcagtacaaaagatactttagcaaaggttcaaagttcaacttcatttttaccagattataattttagtggcagcgacagtaaattaggtgtttcagtatcagggattattggtggtgcagcaactttaattttaattggtggaattggatatatcgtagtaaaaaagaaaaaatatgaataaacttaaaggctcacttttaaaatttggctatattgaaaagttagctaatggtgattcactgattcatcgtttaaatccacttttaaagattattttagcactaatgtatataatttttgttatttcgaccagctgcttagatttttttgaattacccttatattcaataataattggaataatgatttcacttagtaaagtatcatttatggatttatttaaacgaagtttaattggattacctatttctttgtgtattggattttcaaatttactattttcaaccacaataattaatttttatggtgttaatatatcaactggtgtacttttatttattacgatcattataaaaaatatcttatgtttgatggcagtttttttactaatggcaacaactaagtttgatagtattacttgtgaattagtgcatcttaaaataccttcaatttttgttttacaattagtaatgatctatcgttatatttttgttttggttgaagaagcgctaacaatgattcaagcttatcaattaaaaaatccccagtctaaaggaatagcttttaaagatatgggtagttttgtgggaagtttattagttcggagttttgaacgaagtaatgaagtttacaatgcaatgaaatgtcgtggctttgatgttaaacaagcgtatttaaattatgttgattttgagattgaaaattattttttattaatgatggcagtaggagttttaatgatggtaaaggtggtattttagtgattgagataaataatttaaatgttctttataataattcaattagagctcttgataatgtgtcgataaagattgaacagcagaagtgtattgctattgttggagaaaacggctcggggaaatcaactttattatcaagcttattggggctggtggaaacgcaaggtgagattaaaattaatggagttatgttatcaaaagaaacattgatacaaataagagaggtagcaggtcttgtttttcaaaatccagatcatatgatttttttacctacagttcgtgataatttagcttttgggttgataaatcaaaaactggataaaattgaaattgataaaagaattgcggaatttgcgaaattatttaagattgaagatctgctggatcgaatggctaatcatctttctggaggacaaaagcgaatggtaggcttagctagtgtggtggtaatgaaaccagagatattattattagatgaaccatcagcatttcttgatccgaagagtcgaaggatcgttattaatatgttaaaagaattgccccagcaaattatttttgcaacccatgatttagatatggtattggatttgtgtgatgaaataattttattaaataatggaaagatagtatctagtggtaatccctgtgaaattttagctaatcaagagttattggaggcaaatgggttagagttgccacaacgatatcagaggtagacgatgaaagtaaaagaaatattagaaatggtagagaaccatgagatttctgttgatgaagcagctattttgattgataatccaattgattatgcgacgattgattataatcgtaaacgtcgtacgggaacaccggaaatcatttatggatctggtaaaacgaaagaacagattgctggtattataaaaaatatgttagaacatgatcaaattgatattttagcgactagagttgatgcaacaaaggcggcttatttaaagaaattatatccaaattttaattatgataaagaagccaaaacttttattttaaaacaatcggaaactatacaaaataaaggaatgattgttgttgtttgtgcaggaacatcagatattccaattgctagagaggctgtgttaacagctgagtttttaggaaatgaagttaatttgattagtgatgttggtgttgctgggattcatcgactatttaataagatggatgtgatcaaacgagcaaatgttattatagttgtagctggtatggaaggggctttagcatcggttgttggagggttagttgataaaccagtcattgcagtgccaacatcaattggttatggtgctaattttaatggtctttcggcattattatcgatgttaaacagttgtgctagtggtgttagtgtagttaatattgataacggttttggagctgggtatatggctcatacgattaattgtttaggaggaaaacgatgaaagtattatattttgattgtagtagcggaataagtggtaatatgactttaggtgcattaatggaacttattgatgaacctgattatttacaaaaggaattagctaaattgaatatagatggctatcatttacatgttactaaaacaaagaaaaatggtattactggtacttatgtagatgttcatttagaggaacatccacatcatcatgatcacgaacatcaccaccatgaacatcatcaccatgaacatcatcaccatgaacatcatcaccatgttcatcgtaatttattcgatgttaataaaattattgatgatagtgggattaatgaaagagctaaagcattagcaaaaagaatctttttaagagttgcgttagcagagagtaaagttcataatgaagaattggctaatgttcattttcatgaagtaggggcaattgattctattgttgatatcatcggaacagcaatcttaattactaagattgcacctgataaaatatatagcagtatcgttaatgatgggcatggttttattgaatgtgctcatggaacaatttcagttccggtaccagcgacatcggaaatttttgctgctagtaatgtagtagcccgtcagattgatattgatacagaattagtgacaccgacaggggcggctattattgctgagctgagttcatcgtttcaaccgatgcctcctatgaatgttcaaaagattggttggggttgtggaactaaagaattaaatattcctaatgttttgaaagtatctttaggaacaatcgataaaactaatgatgaaattattgtaatggaaacaaatatagatgattgttcgagtgaaatacttgcttatactgctgaaaagctttttgaaaatggagctttagatgtcttctttacaccgatttatatgaaaaagaatcgcccagcctatcgattgagtacagcatgtaaagaagataaattagaattattacagaatattatatttagagaaacaacaacaattggaattcgttatcgtcgtgaagaaagaaaaattttagctcgaaaagcaattgagctggatacaccatatggaaaaattgctgctaaagaagtaactaataatgatgagacttatgtatatccggaatacgaaagtataaaacgattagctaaggagcatgatcttgcagtcaaagaaatatataaactaataaaataatagattttgatcctccgatttaattatgaattggaggatttattaaataaatttaattttagcactaagcttttgtttggggctatctatctatattaaaaaagtgtataatagtatatacaattaaagccatttaatggtctttttttattagattaggtaggagtgagatagtgggaaaatatcgtcaacaaattaaatcgatttgttttttagcctggccggcggtagttcaagaggccatgaatgttgtcgttacatatgttgatacagcgatggtaggggcattaggagctggggcatcggctgcagttggattgacctcaacggttggatggttagtgtctagtattgctgttgcttttggaattgggattttatcagtttgtgctcaagcagtaggagcaaataatgatgaaaaagtaaagcgggtagggcagcaagctctatttttgacattaattgttgggatagctttaactataatgtgtgttttaattgcaccatatttaccaacttggctaaatggtgataaagcaattagaggtgaagcggcatcatactttatgattatttcaattccattattatttaggacagcagctttgattttggcatcggctttacgtggtgtcagtgatatgaaaacaccaatgctaataaatttatatatgaatattattaatataattttaaatttcttgttaatttatccgacacgagaattatttggaattataattcccggtgctggactgggggtaaatggagcagcgattgcgacggctatatcatttgttgctggaggaattatgatgttcttacgttactataaaaatacactatttgatttaaaaaacagtggttttcatttttataaaaaagagtttaaggaatgtttgaatattgggattccagtagtattggaacgtagtgttatttgtttagggcacgtaacttttgcttccttgattgcgaagttaggagtagtacgatttgctgctcatacaattgcaattcaagcagaacaagctttttatattcccgggtatggttttcaaacggcggcagcaactttagttggaaatgcagttggacaaaaagatgagcataaagttaaagaggtaacttatttgattagtggtattacaatgtttttaatgataatttgtgggattgcattatttatatttgctgaacagttaatggggatttttactcctgaccatgaggttatcactttgggggctcgagtattgagaatagtatctatttcagaaccgctttatgggatcttagtaattcttgagggaacattcaatgggatgggtgatactaaggcaccatttgttttttcattatttacgatgtggggaattagggtaaccggttcttggctaatgatcaatgttttccatcaaagtattgaagcagtttggattatgatggtatttgataatatagccagatgtctcttattatcgcgaagatttttaaaaaatggctggaagtaccgtcttaatagttgattaaaagcgggtgtatcttattcgatatacttgcttttaaatatacatgaatttagatttcatagtaaatatttaatataagaaaatataaatttgaaaaaaataaaaattttagatattaaataatatgataattataatttagaactactttttaagcgatattcttaaatttaaaactatactttaccataaaaaacgattttccaattatttgattttttggcagttcaccgtgtgctgattttttataaaattttgtatggattaacaatatgctggtaaatacatttggggattatttttgtatttttcagcttcttcttgacttagaaaaacagtcaaatgtatttgacttgaagaaattatgtgaggcccagcacatccagcataaccttcaatactaaattcataattatcattattaccactaatatcaaaaacctttccagacatcacatagccattcatcaaaaaatatactactgttcctttttctaacatatttatacctctttctataaaattgatatatgatagttaatattttgttttaaatgatttacctcattattagtatgtaattttattgttgtaaatctacaaaatattttaattttcttactacaactggattatagatcgagcttattaagttatcaaatcatatgcattaaataaaaaagaattgatctatatgattatctggatcaattcttttaagcatcattatttgatttaggaagttcaatttttctgcgttctttatgacaatgcttttcaaaatcaatagcaagttgattcatggctgataattcttgaaagctataatcaactttaattattatttgttcttggcatcgatagtaatagagatgatcgacacaattaacaaagatatgctgataaaaactgttagctagatttaattgattaagaaagtcatagagcatatgttcagggagattgtgacagtgtgaaaaaatatataaaccattatctaaataaatctcatagtttttgctcttttgttcttttcgctcaagagcattatctattttattgattacgaattctaaatttttttcatcatggtcgaaaggatttaattttaaagtactatataaaggtttttttatgtcagcaactgcttcagctggagttaatgcttgagttacttcaattccaaaattacgttttggaatgcgaaggtcaggacgatcagcttgaataatattatcagctgatacatctaatacttttgttagggttaatgcagcatatttttcaaaataattcttactatatgtctctttcattaattgacctcgatttttaaaaagtgataatcattcattgattatcacttagtgggttttatactgtcttctttattcatattatagcatggtttattttattttcaaagtaagtaataaggatatttggatattcattgcgatatatttagataactgttatacttttataaaggttttttagataaggtggtatttatggttgattatagtattaaaaagtataatcgtaagattgtatatcagctgatatatcaagctaagcaaattacaaaacaggaaattgcggaaagattaaaattatctttgcccactgtttctagtaatctcttggaattagaacaggctgatttgataaaaaaagaagatattaatgagtctacggggggacgtaagccgttagcaatctctattaaggaacaatctagaattgcaattggtgtcagtattttaaaagaaggaataacttttgttgctttagatttgtatgctcaactgattcgtaaacaaacagttgctttagtttatgataatagtgaaagttattttaaacaatatggacaggcattaaatgaatttatcgattgtttacaaattaaaaaagaaaattttttagggatcactatagctattcaggggatcgtatctcaggatggaaaaaaggttatttatggtccaattttaaataatcagggattaacgttagaaaagtttgaaaaatctagtgatttaccagttaaaatgattcatgattctcatgctgctggacttgctgaattaaatttcagtgaagataataacgatgctatttatctatctttaaatcataatctaggtagtgctgtatttatggctggaaaggttttccagggaaataattacagttcgacatttgagcatatgacattagtagagaacggacgtcagtgttattgtggtaaaaaagggtgttttgaagcttattgtaatgaagatgctttattaaaaaatcatacaaatatgacattagaagaattttataaacaattacggcaaaaagaccaaactgcaatgcaatcatggaatgattattttcattatctagcattagcaattcataatttaaccatggttttagatgcaccagtaattattggtggtaaaatagcttcattgtttgaaaatgaagatcttgatctattaacaaaattagttagtgatttggatccattaaagtttactgttccagatattaaaataggtcaatgtttaaaagaaacagcagcaattggagcggctttgacagatattaaaaagtttgttgcagaaatataaggagaagataatgaaaaaagcagttatatttgatatggatggtttgatgatcgatagtgagcgagttacttatgaagagtattgtcgtaaattagaacaattaggatattcttttgatgaagctgtatatcgcttatgtttgggaaaaaataagcagggaatatgtcaagtattttatgatcattttggaactgcctttccaatgactgaagtatgggatgatgtacatattaggcttgatgaacgtttagcaaaagaggttcctcttaaagcgggattattagaattattaaaatatttaaaggcaaataattataaaacaattgtggcaactagcagtgcacgggtacgtgtcgatgttattttaaagaatgcacaaattgaacaatattttgatgatacgatctgtggtgatgaagtgattcatggaaaacctaatcctgaaatttttttaacagcatgtaaaaaacttaatgtagcaccaagtgaagcattagtgttagaagatagtgaatcaggaatcttagcagcctatgatggtaagatcgatgtcttatgtattcctgatatgaagtatccagaagctgattttgcaagtaaagcaactaagatcatctcatcattaaaagatgtaattgaatatttaaagtaatagtgaaaagtttctatcattgatttgataggaacttatttatttttgagaagtttttgttaaaaaaaatacgaatattgttataaaaatcaaaggttatataattttactaagtggaggtattgtgatgaataaactaacaaatataaaagcagtaatgtgtgatgttgatggaacattgttaaatcaagatggtattgtttcacctgcgacagttgaagcaattaagaaaattagagaaaaaggaattttatttggtttatcaacagggcgtgatgttcatagcgttaaaacacttttaactgtatggggaattagtggcttggttgatgcaatcgttgggactggaggtgctgaaatatatgattatcaattaaatattgataaatcaagttatccgctggatggtgaattaataaaagatattattaaacatcatgaaggaatggatcttaattttgctattccgtatgaagggacattatatgcacctaaagatgatgattatattcgtgatttagcacgtgatgatcgtgtgccatataaagttgtagattttgatgtctttttaaatgagccacgggccaaattaatcattgtttgtgcacctgattatatggataaagttattgaaaaaagtaaaactttttctaatccaaactataaatcagcttctttaaaaacagcaagtattttatatgaatatatggatcctcgggtttctaaaacgcatggattacaagaagttatggcaatgcataaaattgaaatgacagatttatgtacttttggagatgctgataatgattatgatatgactttaaatgctggagttggagtagtcatggctaatggaagtgaaaaaactaagagtgttgctgattttataactgatgataataatcatgatggaattgcaaattttattaataagtatattttatagagtctggtgattgaagtgcactatattgttttaatataaccaatatagtgcattttagagttggttttttttatttagaaataataattaaattagtttaaaaatattattttttcgataaactatagtattggagataatataaatgtatggattgattaattcatttttaatttttgaattaggagtcatcgtgggggctcatgtgtttgtttcaaatagctaaatcaaaagattaagtctagtaatagactttttatttttttggaatgatgacgataaaagcgggaattattcaattaggaggtataagaagtgaacaagatagaattaagtaaagtaaatgaagaagggtattatgaaattcgtttagaaagtgttggtgggttaggggctaatttatgtggaaaattattaggtgaattaggtgcggcttatctaggatttaatgcttcaagcttttctagctacggttcagagaaacgaggttctccagtcaaggcgtttattcgttattgtgatgaagataaagaaattactgttaatactcccgttacgcgaccccatttgcttgggctttttcatgaagcgatgataggaaagttacaagtaacagcaggagtcgatgaaaatagttgtattgtcatcaacagcggtgagcaaccagatgtaattagagataaattaaaattatgtgctggaacgatatattgtattgatgcaatttatttagcaatgaaaataaaatgtaaagtcaatatgatcatgctgggggcactagctaaagcgagtggctttattcctttagagacagttttagaattgattgaagctactttgggtaaaaaatatcctcagctattacaaaaaaataaagaagggataattgaaggttataatggtgttgttagtaaaacgtttaatgatgatggtaagtatccgttcattccttatcgtgaaatagaaaatgactggggttatcaaaatgcaccacttggtggtgtgaatccttgttttggaagtactatttcgaatgatttaagtgcatcacgggaaggctatataccattgtttctccaagaaaaatgtattcaatgtgcacaatgttatattacttgtccggatatggtttttcagtttgaaccaggtatttataaaggacgtaagatgatggtaaataaaggtttggattatcatcattgtaaaggatgtttacggtgtgttgaaatttgtccaactcaagcactggttagtggagtcgaacgcgaacattcaaatttaaaatggtttattcgtaacaaagatttaattgttgagcatatggattatgaagatgtgggagcaaattcgtggataacgagtgattcgtttttggaggtagaaaaaataacggaggtaaaaaatgatggaaaaacaaaagatggtatttgaaagtgggaatgaattggcagcttatgccgctaaacagattaattatcatgtaatgggatactatcccattacaccatcaacgcagattgctgagaatttagatttaatgaaagctgagggtaagcatgagattgctttaattgctgctgaaggtgagcatagtgcggctggaatttgttatggtgcaagcgttgctggggcaagagttttcaatgcgactagtgccaatggtttgttatatgcattagaagagtttccagttcaatctggaacacgatttccgatggtaatgaatgtagcttgtcgaacagtttctggtccactttcaatcaagggtgatcacagcgatatcatgtatatgttaaatactggatggattattttatttgctcatagtccccaggcagtttatgatatgaacatttgtgctctaaaaattgctgaaaaagttaaattgccagtagttattgcgtttgacggtttttttactagccatcaaaaaaataaatgtcaagtctttgaagatgatcaagttgtccaaaattttgtaggtaaatatctgcctgaatatcaaattcttgattttgaacatccagtcacagttggctcttatatgaatgaaccggatttaatgaataataaataccagcttcatcttgcaatggaggaagctcgagaggttattccggctatttttaaggaatatgaaacaatttctaatcgggcttatcagtatgtagaaagttatcaaaatgaagattgtgatgtcttaatgtttgttctaggttctggatttagcagtgcaaaacgagctgttgatgaattacgcaaagatgataaaaaagttggagtagttacaatcaatgtactgcgtccatttccaagtaaggaattaattaagcattttaaagtgcctaaaacagtgattgtttgtgatcgtcaggatagttatggtgccaatggtggaaatatgtctttagaaataaaggcggcaatgcaggaggcagggatcactacccgtgtaattacgagaatttatggcttaggtggccgtgatttttataaagatgatgcaaaagcattattattaatgggatttcaaaaagatgtaaaattatttgattatttacatatttatcccggtaaaattgaacaaccaataactcaattttttaaaccaatcaaagaaactcctgatgacttcaagtgtgtttataatgaagaaaaacaaataatggaagttaagccgtttacgcttaatcaaattgcaaagatgccccaacgtttatctgggggtcatggtgcttgtccaggatgtgggattcccgtcaatgtcaatttattattaagtgcaatcagtggaaatgttgttttattatttcaaacaggctgcggaatggttgtaacaacttcctatccaaaaacttcttttaaagtaccgtatgttcataatttatttcaaaatggggcagcgacactttcaggaatcgtagaagcgtttaaccaaaaagtaaaacgacatgaatatcccgaaggagaaattacttttatcatggttagtggtgatggaggaatggatattggaatgggaagtgcactaggtgcagctttaagaaaccatcacatgattatttttgaatatgataatggtggttatatgaatacaggttatcaattatcatattcaacaccattaggggctaaaagttcgacttctcatcttggtcaagatcagtttggaaaatcattttttaataaagatatgccagcaatcatggctgcaacaaatattccatatattgctactgtagctgaatctaatccaatagattttgttagaaaagcgattaaagctaaggcttatgctaaagagtttgggttagcatatttgagaactttatctgcttgtccgttaaattggggtgatcagccaaatttagaaaaaagtgtaattgaagcaggggtaaatagttgttattttcctttgtttgaaattgagcagggtaagtataatcttacatatgatccacagaaagcaaagaaaaagattccattaattgattggtttgcaatgatgcagcgaactaaacatttaagtgatccaaagtatacaaaaattgttcaggctgctcaagatgaagttgatcgacgttttgaaattttgaaaaagagggcagatgatcaaatttaataaataatataaaaggttattgcttgttgtgtcaataaccttttataatgagtaaaagaaggtgattaattgtggaagtaactgaatatgctaaagatttatatattttagatgatggtcaggtacgagaatttctaattatcggtagaaatgaagcgatattgattgatactggttttcctgagacgaagataattaatgaagttcagaaacttactagttttccgcttaaagtactgttaactcatggtgatggagatcattgtgggggacttgatagttttcaagaatgttatgtacatcagggagataagggtttaattaaaacaacaataaaaattaattgtttaaaagaaaaggatttgattgaaattggtgattactgttttgaggtaattgagatacctggacatacttatggaagtattgcatttttagatattcagaagaaattattaattgttggtgatattgtacaattaggaccgatttatatgtttggtgagcatcgaaatttagatttgtatattcatagcttagaaaaattaaatacatatcaaaatcaaattgaaacaattttgcctagtcataatcgttatccattaactaaggagtatattggtcattgtctatcagatgctagattgttaaaggcacataaacttttaggtgttaaacatcaatttttaccatgtcgggaatatcgtggtaaaaaaatttcgttctattattagaaataataactttcgttttgagaataatatgattgaaacgaaagttgtttttattgtatttgaaatattaatatgataaggtaataaaagaaaagagcggtgatgaggatggttaagatgttggcaagacatacaaaaatactagaattaataacagagaataagaaaatggaagtaactaaactttctcagttactcagtgtttcacaagtaacaattagaaaagatttaattcaattggaaaatagtggattgattgttcgtgagcatggatttgcaactttaaattctagtgatgatataaataatcgtttagcttatcattatgatattaagcaaagaattgctaaattagcggtagaatcaatagaagatggtgaaaccgtaatgattgagtcaggttcttgttgcgcattggttgctttagaaattgcgcagaccaaaaaagatgttacgattattactaattctgcttttatcgccgattatattcgtaaagttgctaaaattagaattattttacttggtggtgaatatcaaaatgaatcacaagtaatggtaggaccgatcacaaaaaaatgtgttgaatctttttttgttgataaactttttattggaactgatggctttactgaaacctcaggctttactgggaatgattatatgcgtagcgaaacagttagagatatggcaaaacaagctgataaagttataattgtgacagattcatttaagtttttgcaaaaaggggttgtaactttgattcctactgcggaaatcgcatgtattgtaactgatactcatattccaatagaatgcgaaaattatttattagatcatggaattgaagttaagaaagtagaaaattaaaaaagcttattttatagtaagctttttagaaaaaacacttgatgtcttcattgataaaaatattttgatattcttttaagtcttctttgtggagggcttttttattttttaaactatattctagattgagcatttcatattttttttcaccaaattgatgaaatggtaataattgaacttttaaaacaccgatattttttaagagtcttgctagtcctttggcatcatttaatgaatcattaaaatctggaataacaggaattcttggtaatacttctattttgttttgtaatgcccactttaaatttttaattattaaatcattataaacacctgtacctaaaaaatgctgctcacgatcataatgtttaacatcaaataataacagatcaaataatggagcaagtttagtaaaaagctcatgttcaatatatccggttgtttcaattgctaaatgaagctgatgtttttttagttcattaactaagtgaaataaaaatgctggttgtgacattccttctccaccggaaatagtaatacctccattagattcttcataaaaatctttatcttgaagacaggttgtcacaatttcatcaattgttttatactcaccttcattttttagggcaatttgaggacatttattaacacatctcaaacatccattacatttattttgatcaataataattttatctgcaattaatttaatcgcacctgtaggacaattattgatacaggtcatgcaatgcgtacatttgttatgatcccacaaaatttgaactgcttttagttgtgattcaggattagaacaccacttacatcttaatggacagcctttaaaaaatatagttgttctaattcctggaccatcatgaatactaaatttttgaatattaaaaattatccccttattttccattatgaatatctccttatcttttcattatttataatatcatgttgattgcaaattgtaaatgtttatatttcatttgaaaccaatatatactgcttttgaaataaaaatattgacttattgttcgtatatgttaatatataggtgtaaatgaagtgaatttatgttatgaacgaaacttaataatttattttagtaactttggaggaaaaatatgaaaaacattgaacattttggtgatttaacacctagaatgaatgattttagagaaaaggttttagataaaaaaccgtatatttgtgcagagagagcattattagctacagaatcttatagattatatcaaaatcagccaccggttatgaaacgggcactaatgttaaaaaatattttagagaaaatgtcaatttatattgaagatgaaactttaatagttgggaatcaggctgcttcaaataaagatgctccaatttttcccgaatatacgttagaatttgttattgatgaattggacaaatttgaaaaaagagatggtgatgttttttatattactgaagaaacaaaagcagctttacgttcaattgcaccattttgggagaataataatttaagagctaagggggaagctttactacctgaagaagtaaatgtttttatggaaactggtttctttggaatggaaggaaaattaaattctggagatgctcatcttgcggttgattatgaacagttactaaaaataggattagtcggttatgaaaaaagagtgcgacaattaaaagcagagttggatctatgtgttccggaaaatattgataaatatgttttttataaagctgtattgattgtaattgaagcagttaaaacttatgctgataggtttagtcttcttgctcaagaaatggctgaaaatgctcaaagtcatagaaaggatgagttattagaaattagtaatatttgttctaaagtgccttatgaaccagcttcatcttttaaagaagcgattcaatcagtttggtttattcaattgattttgcaaattgaatctaatggacattcattatcatatgggcgtttcgatcaatatatgtatccatatttgaaagcggatctagaaaaaggcgtaatcacggatgaggaagctgttgagttgctaacaaatttatggatcaaaacattaactattaataaggtcagaagccaggctcacacatttagcagtgctggtagtccaatgtaccaaaatgtaactattggtggacaaactcctgataaaaaagatgcagtgaacaaactttcgtttttagttttgaaatctgttgctcaaacaagattgccacagcctaatttgactgttagatattataatggtttaaataaagaatttttagatgaatgtatcgaagttatgaagttaggaacaggaatgccggcatttaataatgatgaaattattattccttcgtttattgatctgggagtaaaagaggaagatgcttataattattcagcaattggttgtgttgaaacagctgttcctgggaaatggggatatcgttgtacaggaatgtcatatcaaaatttcccaagaattttattagcagtgatgaatgatggagtagatgtaacttctggtaaacgatttgtaaagggttacggctattttagagatatgaagtcttttgaagagttgcaagatgcctgggataagtcaattagagaaattacccgattatctgtaattgtagaaaatgcagtcgatcttgcttcagagcgtgatgttccagatattttatgttcaaccttgactcaagattgtattggtagagggaagacaattaaagaaggcggagcagtctatgatttcatttctggattacaaattggaattgctaatatggcagatagtttggcagcaataaaaaaactagtttttgaggaaaaaaagattacaccgcaacaattatgggatgctttacaagatgattttatgagtgaagaaaatcaaaaaattcaaagtatgttaattaatgaagctcctaaatatgggaatgatgatgattatgttgatcaattggttgtagaggcatatgattcatatattaatgaaatcaaaaaatatccaagtactcgatatcaaagaggacctgttggagggattcgctatgcaggtacttcctcaatttctgctaatgttggacaaggatatgggacaatggcaaccccagatggtcgtaaagcccatactccacttgctgaaggttgttctccagctcatgcaatggataaaaatggacctacagcggtattcaaaacagtttcaaaattaccaacacatgaaattaccggtggtgttttattaaatcaaaaagtaacaccacaaatgttagcgacagaagaaaataaagagaaattagaaatgataattaaaactttctttaatcgattacatggctatcatgtgcaatataacgtagtttctagagaaacattgattgatgctcaaaagaatccagaaaagcatcgtgatttgattgttagggttgcagggtattcggcattctttaatgtcttatcaagagcaactcaagatgatataattgaaagaacagaacaaacattataaaaggggaataaaaatggaatttattattgatactgtgaatttagaggaaattaaagatgctatagatcatatgccaatcgtaggagtgacaagcaacccttctattgtaaaagcaactgcaccagaaaacttctttgatcacatgagaaaagtaagagatattattggaacagatagaagcttacatgttcaagtgatttctaaaaattgtgatgagatggttaatgaagcacatcgaattttaaaggaaattgataatcgagtttatgtgaagattcctgtatcatatgaaggaatcaaagctatcaagattttaaaagcagaaggcatcaatgttacagcaactgctgtttacgacctgatgcaggcatatatggcattggcagccggagctgattatattgctccatatgttaatcgaattgggaaccttggtagtgatccgtttgaattaatcaatgagttgtcaaatcgaatcgtgatggatgattatgattgtaagattttagcagccagtttcaaaggtgtccagcaagtaagagattcttttaatagtggagcccaagcaattacagcaccagtcagtgttctaaaagcgatttttaataatccaaatattgaaaaagctgtagatgattttaatcaagactggtatagtgtttatggagaaaataaaggaatttgtgatttataaaagaaatggtggaggattccactttttctttttattaaagaaaaatgagtggtttaagaagtttaaaaatcagtggtgaaagaatgctcggataactgatgataaatagtataaaatgttgatataatcgtataatatttataagtcataatatttgcatttggtatcaaaaataggtatgctatttattagagaaaaataaaggagagaaataaaagatgttagaagtgggaagtattgctccagattttaccttattagatcaaaatggtgacagtgtttcattgagtaattttgttggaaagaaaataattttatatttttatagtaaagataatacgccaggctgcactaaacaagcttgtggatatgctcaaaactatcctcgattcaaagaaaaagacacaataattattgggattagtaaagatacggttgtatcacataaaaaatttgaagaaaaatatcagcttccatttattttattagctaatccagaattagatgttttacaagcttatgatgtttggaaagaaaaaaacatgtatggtcgaatggttatgggtgtagtgcgaactacatatttaattaatgaagaaggtattatagaaaaggcatttacaaaggttaaagcagcagatgatgctgagcgaatgttaagagagattgagagtgaataaaagacagatgcaattaattattggtattttagttatcattattattgttttattagtgtatcgtaatcatcgccaagaaactgcttatcaaaggatttcggcgagtgaagctcaaaagattatggatgaagaaagtaatattatcattattgatgtaagaacagtagatgaatataagaccgggcatataaaaaatgctatctgtattcccaatgaattaatttctaataaagaaattgcagagttaccagataaatcacaagaaatattagtatattgtcgcagtggaagtagaagtcgtcaggctgcaaacaaattgattaaacttggttatgaaaatgttattgattttggtggaatcattgattgggatggtgaagtagttaaataagagggtgctatttgtagtgaactttaaaagttgagtgagcaactagaaatgatcactatattttggcacctttttcttttatctaaatagagattatgctatactacatcctgataaggaggctatgatgataaaattaattgcaacagatatggatggaacatttttggattcagataaacgttttgatccggaatttattgatatattttataaactaaaggaaaagggaatcaaatttgtaattgctagtggtaatcagtattatcgattatatcaaaaatttttaccattaagtgaacaaatgtattttattgctgaaaatggttgttacatcgcagagggagcgacagaattgtattgtaatacaattacacacgataatgttgaattgatcaaaacagcattagccccatatgataatttatttatgatcatgtgtggtcggaaaggggcttatgtcttaagccgtgataagcattttgaatcattggtgagattacattattgtaattatcaatttgttgattcattcgatcatatcgatgatgaaatcatgaagatttctattaatgatccagaagaacagatagaaaaatatttgcaagcattggagccgcatttaccagtcgcagttaaggttgtaacagcaggaaatatgtggatggatattcataatcgtgatattaacaaaggtgttggaatgcgttttttacaagcaatctatgaaatagaacctgatgaatgtatggcttttggggatcaaatgaatgattatgagttattacagcaagtgaaatatggttatgccatggataatgcagttctgccaattaaggagattgcttatggtacaactagatccaatgatgaacagggagtcttaattaaaattaaagaagtattggatcttgcctagtattgctaggctttttttttacacgaaaaaaggtaaactaccttttattaataactaaagttagtttacctattactctaaagccggcttgactttcttgatttattacaatgggtgtatattcaggattagctggttgtaatataatgcagtgattattatcatcacggtagaattttttacatgtagcaacattatcatcgattgtaaagcagccaacctcaccatttctaatttgattacttttttcaaatacaattaaatcaccttgattgatattttcattgatcatgctgtcaccatcggcatattgacaaaaatattctttactgggtgaaagtaatgtttcaggtaaggatatatattcatcaacattgtcatcaacaaaaagaccagttccacaactaatatcactgtataaaggaatagtaattgaatcagtaataataggttgattgctctcgtcaattcctaaaaagtatgaagcaggaacatcaaaaatttcagatagtttttgaatcgtgtccttttttaaattctcaactcgattgttttcatattttgcgatggctgattttttaaccccaagtaagttacctaattgctcttgagttaagcctttttctttacgtaatttttttattcgttcaccggtcatttgtattcactccttgtgtcttaattttactattaaataactagttgtgcaatcattaattaacaaaagtgtcgaaaaaagatactttttgttgacaaaataatggaatggatgtatattaaaagtgtcttataaagacacttaaaaaatattgatataaaaagatgaataaatagatactaatgatggagggaaagattatggaaaacaaagaaatgaattttagtggtaaaggaattttaacggttattacggggataataattatgggttctacgattgcaaccttaagttcttatttgttggatttaattatgctttaatgcgcatactagtaatgaggtgagctgctaagtgaaacgcagagataaagaaattaaagatcaagatgaaattgattatgaaaatcatattatggaatatgatgaccaatatcttgataactccaatgctcaagaatagagaacagcactttatggtgctgtttttttatggtatagatatgcagagaattaatgtttatcgtgtagttattaactttcaagttaccaaatagaaaggtaaaatgcacgaagctaataaatgattatgatataatagatgtattaaagaaaggtgtgaaaagcatgaaagttgaattaaagattgatcctaattgtcaagagccttgggcagtgataaatgtagctaagctgacaccatcgcttcaagctgcgattacaattttggaaaaagagtgtgaagaaatgatttttacggctcaaaacaatggtaagatctatataatcgatccagtaaaaattgagctgattcgtactgaagggcgagaattagcattatatgatttgaaaaaagaacgctatgttttaaataaaccgctctatgaagtacaagaacaattaggaaaagattttgtacgtatatcaaaatttgcaatcatcaatattaagcgtattaatcatgttgaagcatcttttaatggaacgatggaaatagttatgaagaatggtcttgaagaaatcataacccgtagttatcgaaaactgtttaaagaaagattgggggtgtagagaatgcgctttaaagatttagtgagttatttttttggtgggattgcttggggatgtacgtttttggtagtaataaatctaattggttatacagtgattggcagcacgtttttagaacctttgatggaaaattttgtcatgcatgcagtaggagcaatggtagttggagtttgttgtggttcgacttcatatgtttataaaattgaaagtttaagtttaagaaaacaaatagcttttcattttacgattgggctgggtggatatttattaatagcatataaattgggatggatgccaattagcaatatcggctatgttatcacttttatattaatggcaattattatctttacaagtatttggacgggtttttatttttataatcgaaatgaagctaaaaaatataatgctaagataaaagaaatagaaaaagaaaatgataattaagattattgttaaaggaatatcagaagtaaagctttcatgatataatgaataatagtgaaagtgagtgataataatgttaaattttcgttatgctgatataaatgatttagattttttagtggagttaaggatacgtgatttaagactgttttctaatcaggaaatcttaccacagacaattaacaagattcgtgatttctacaaaacaggtattatcaatggtacctgttttacattattaggatttgataatgaattattggctgcttcaggaacattatacttatattccttaatgccatcaaatgaaaatccttcaggaattatggggcagttaacaaatatatgggtagatgaaaaatatcgtcatcaaggtattgctagtagaattgttagtgacttattaacaaaaggacaaggtaaatgtggaatgatttgcttgaattcttcaaaagatgcaatcgcactatatcaaaaactaggatttaaaaccaaagaaaggtatatgataaaacaatgggactaataattaaaaagcctgatgatgcaatcatcgtaaataaaaaagatggaactcatgttgcctattatttgtttgacgagtatgaagttcacttaaacagtttaccaccgcaaactgaacaagtatggcattttcatcaagctatcgaggaagtaatcttaattattgaaggagagatagaaatccactatttagataatgataagagaatgcggcaaagagttcagccaaatgatttaatattagttaaagatagtattcatacattgattaattgtagtacgaaagaatgtaagtttgttgtttttagattagtacttgatggtaagaataaacgtgatctaatcaagaatgacaaaaaggttgtaaatatgctgtagaattgtttccaaagaaacaatataaggaggaagaatatgtttattgatttaactttagaagttactccaaaactaactcaggatgctaaaggaaatgaaagtaaagctaattttgggcatttaggcactcattttgatgtgatgaacaaagagtttccattatcttatttagaaagaaatggagttatttttgatgtccgaggtattgatgaaattgaagtgattgatttggaaaaaattagatctggtgattttgtgattttttatacaggatttttagaaaaggcaggatatggtactaaagaatattttcaagcccaccctcaattatcaaataatctgattgaaaaattgttagataagaaagttagtattattggaattgattgtgctgggattcgtcgcggtaaagaacatacgccgatggatcaatattgtgctgatcataatgcatttgttgttgaaaatttagataatctagaaagtttattaatgcaaaatgagtttactataaatacttatccgatgaaatttagtgaaatgacaggcttgccatgtcgggtagttgccaaggtagattaaaatgcaagtgattctcgatttatttactgaactatacgaaaaacaagatatattatcaaagctaacccaaagtagcagtttgcaaggttatggttattcagtaattcattgtcttgatgcaattggaattcttgatgggcctaacattacaaaaatagcagaacacctaaaaatgactcgtggggaattagtaaaattatcaaaaaattagtttctaataatttaataacaacatatcaaaatgataataataaaaaagagatatattttaaacttacagctgccagagaacatttatttttagagcagcaggcacgacatcaaaagtatattgaacgtgatataacttttttaaaatgacaagatgagcaaaaaatgatagttgttaaagaatttttaactgtaataattatttaaaccatcaaattgaagaattaagcaaatagcagtattgttcagaggcgctagttttattaacaaaattagtgcctgttttattaacttaatagattgattgtaaacggatacaaaatatattataatacttatgacaatacttgtcataagttaggggaggtgctcataatggatgagttcttgcagggaatcaatgcatcgatttatttaaaatggatattaatgcaaaacaatcattatagtttaaatatcaaagttgatgacaatgataataatacgatcatcatcagtaatgaaatagtaattgggaaaataatttattatggcaagggaatttttgaggaagagttaaatgatcgtcaaacaaaggaaaaaatcttttatcttcattttcaattaacacattttaatcatgcagtggagttgtttaaagaaatgattaattgtgcattagaagcaactaatcggccgcaaataagagttttattatgctgtagcggtggtctgacaacaactttatttgcaagtaaaatgcaagagctggcaaaattggaaaatctatcatatgagatttttgcaacaggatattcacgcttatttgagattgctaatgattatgatattattttaattgcaccgcaagttgcttatatgctgccacaagctaagcgacgtttgccagataaagaggtagtaacgataccaacacgcatttttgcaacaaatgattattcaggagcattaaaaatcatttatgattggtatcaaaacaaggaggaaaaataacctatgaatatcagtaatactaaaaatctacgacaaataaatcgggataaagtcatggatatttttatggagcaagaaacttgtactaaaaatcaattagctttagcgactgggctaagtttagctacaattacaaatattttaaaggaattgctggcaagtaatgaagtattaaaagatggtgagttagaatcgacgggaggaagaaagagtgttgtttattctttgaatagcgattattctcggatgctaacgatttcggttaataaagaataccggcgggtacacttgatttatcgggtttataatctggcagatgaaatagtttttagtgatgaagtaatcaaaaaggaagttaaagttaatgatatttatgatattattaacatcgttttagctaagtttgataatataaaagttattggaataagtatgccagggattattaatgatgggcgagttacttcaactggattaacaaattttaatgatattgatttatattcattactaaccaataaatatagtcaagtgatcatattgggtaatgatgtaaatacagcagtaattggtttttatctagcagaaaaaaattatgaaaatgtctgtctgttatttcaaccaggtgaagggtatggtggtgttggaacagtaattaacggtcaacttgtaacaggtaaaactaattgtgctggtgagatacaatatttacccttgagtcaagatgatcaattgaaattgcttcagtctccccacggaacgattgaattgttgagtaagattgtaatttgtttaaccgcgatcgtaaatcccgaaatcgtagctattagttgtactaatcttgagcgtgctagtgatttagatgaaacattgaaacagatggttccggctaaatatcttcctaagacaaaaaaagtaactaatttaagtgagtatattttaattggtttacaactgatttgtaaagattctttaaaaacaaatcttgtcataaaaaaacaatcgattatttaagcatctataataaaagatgcttttcttgttaataatttaattggtgataagatgtcagaaaaagatatacaattattggtcatgtgtttaaaggaatatattaaaaatattgatggtgaaaggtttaaacaactatttttaggttatgctgaatacatggcacgaaattatgggcaggattgtttgattgatgaatatgatttaatgatggaacaagtagaaaaatttgttgatgagcagcatttggatataaatttattacctccatacaagcgggatgttttttatcgattcattaaaaatcattattcaaaacaagatatcttaagtttatattattttaatgatgagattggtgctttagaatgttttattgatatgattgatagtaagtatcaataaaagccttgtattatcaaataaatttgatatgattatatagaaacgaggtggaaggatgtataaattttcttgctaaaatttaataacagtatactttgagttactgtttttgtgcgcgagaaaatatatccttttaactaaatccgattctaagattctatttaagctacgagtgtatattttcttgtagctttttatattgttaggaggaatggaaatgggtttattagacgtaaagaatttatcgtttaaatatgataatcagattgaaaaggtatttgataatgttagttttcaaattgatacaaattggaaacttggattgattggtcgaaatggtaaagggaagactacgttgttagaattattgatgtctaaatatgaatatcggggctatattacccctaattatatctttgactattttccgtatcatattgaaaatgaaaatattaggactttaaaaattgttgagaatattcttggtgaatttgaattatgggaattacaaagagaattatcattacttgatgtggaaaatgaggttttagaacaaaatttcgctaccttatcaaaaggacaacaaactaaagtattattggccattcttttttgcaagcctcatgattttattttaattgatgaaccaacaaatcatttggattatcacggtcgacttttactaagtaaatatttgaaacgaaagaaaagttttatattggtaagccatgatcgtgattttttagatcgttgtatagatcatgtcttagctataaatcgtaatagtatcgaagtgataaaagggaatttttccctttggtatgatttgaaaatgaataatgataagagggaaatagaaaagaatgagcagttaaaaaaagatattgggcgtttgaaaaaggcagctcgtcaaaatgaagattggtcaaataaagtggaagctactaaaagtgtaaaggttgctggtttaaaaccagataaaggttatgttggtcataaagcagctaaaatgatgcaacgctctaaaaatattgaacgacgtcaaagtaaagcaatcgaagaaaaaagtgatttattaaaaaatattgaaacaatcgaaaaattaaagatctttccacttgaatactcaaaacagcaactatgttattttaatcatgttacgattagttatgataaacatattattgttgaaaatttaagttttgatattaatcagggagatcgacttaatcttgctggaaaaaatggttcagggaagacaagtataattaaaattattatgaaagaaagtaataattatcaaggaaaggtaaatattggaaataatctaaaaatagcgtatctaagtcaagatgatagtcatttaaaaggaaagctggatgattatgcaaatagtcttgatattgatttaagtttgtttaaagctattttaagaaaattagatttttctcgcgaactatttactcaggagattagtacttatagtaaaggtcaaaagaaaaaagtaatgttagcgggagtgttatgccaagaagctcatttatttattttagatgaaccattaaattatttagatatttttacgcgaatgcaggttcaggaattattgctaatatttaaaccgacagtattatttgttgaacatgataaatatttttgtgatcaaattaaaactaaaacgcttaacttataaagaaggtcaagtgagttagaatatgagaagaaaacaaaagtaataatgataattaaagactatgtaaatcttgaagcaaccccttttagttggctatgtcgagcttttaggggcgcttcattttatatggtctttaacaattatttaggataagtcataccttcatggtaatagacataacgatctcgtccattgtgtttagcattatatagagcaatatcaactttattatataattcagtaaaagatatctctggtcgattatcgatatgaattcccatagaaatactaatttctttaggatagttattggcagtgacatattcatgaatttttttaattaaagcatttgccttttcgcggacgatctctttatcatatatatctttgataaagattaaaaattcatcaccaccaattcttccaattaaatcacttgctcgaaagaaacacttaattatttttacaatttcaattagaaaacgatcaccgatgatatgaccataagtatcattgatttttttaaaataatcaatgtcaattaagatacaagcataggaaagattattttttaagatatgacaatattcttgaatcgcgctagtaatatataaacggttatatgttccggttaggggatctgttattgactggtgttttaatcgtaattctgaggaaatatcaacaactttgccgacaactttagttaatttattatcattatcaaatatccgtcgaaaagttagacggtaccaagtataactttgtggtgcgattgcaaaacgatattccaatttatataattcattagaaacttgatttgataaaattatcttcaaatcctttttaaagcgttcgatatcaccatgatataaatgagtattttttaaatcaactgtcaaaaaattagtcaatatatttttgactggagtatcagcttgtagctgttggtatactagtgaattattttcaacatcatattcaaaaataatatcatcagataactgagatacaatttcatagcgttcttgatcaatttttaaacgattgaccatttctttaagttcagagatatcagtaatgatactatttattactacttgaccgttttcatctgtaactttacgtccgctatccattacccataataaacttccgtctttttttcgaatccgatattctgttttgtattctggtccgatggcaaaacatcgtttacaatctgctaaagcagcaggtaaatcaggtggatagactgcgccaacagcagtaccatgactcatttccatgaattcatcataagtataaccaagcattttacagagctcttcattaacataaaagtaagtataaaattcatcatcaagactacctttcattcccccggcggttgttctgataatcatttcaatttgttcattttttttctttaaagcttgttgtaactctttatatccgagtttagcaatttcattggtatagaattcttcttgactaattgcatcattgggggtcgaggcatgaacatgaataattttaagtgtagtattaaattgttttaaaacaatcgttacccgttgatccatatcaaaaagggctcctttgctttcgatatgtaaatgataattacaataaacgattccaatattatcgtcgttgtagataacataacaatcttgaaaggtaatttcaggaacataaccctcgttacacccctctttaaagtattgatcaaattgtttaaggttgtttgccatagtattattactagcccctagccatgagccttctggagcaaacatattcttgacttgatcaaaatttctgctagtgaaatatgtattgataaatttttgagcagttagagttaaaaagtcgtctttgatcattgtttgcacccccttacgtttagtttaatagtaacacttattattagtaatgttaataagaagatttcaaataaaaaaagaattgtggtttactcagccacaattcttttgattttcgaaacgttttcaacaactttttaatttcacttttcatctacgcatcttctattactttgccttatattatcatgttgttttaacgtttctttaaaaggctcctgttctaattttttattattatgtttttttagaactcttccttttatctacttcaaatatatacctaaaaagatgatttttcaagcatctttcaaatgttgttgtttttatttatttttatataatttatagtataattaaatttaaggggtgaaaaaagtattgaatatatcaatgctttttttattgatggaatgatgcggttgaataagtcaattcaataaagtacaattaaggtattaaagggaggaagtcgatataatgaaaagattgagtaaaattttattagtatttttgatggttttaggtcttactgcgtgtagtggtgggagtaaagagaatgagccggcaaaaattgaaatgggaaaagaaaataagtttgatgatttagtttcatataaaattgaaacgattagtagaccacagcaaattacccctgatgtaattggaagtttttatacatactataaaccatctaagtcaacaaatgtattaattgatgtgactatgtatatgactaatctacaaaaaaaggaaatgaagctatctagtacgttgaagggaacatttgttattgataaaactgattatgtcgcttcaacagcaatggtaagtgaagatggaaaaacaattagtcaaggtggaagtttagttgctgaggggactaataaagtgcatttttatgccgaagttaaaccaagtttgttaaaaaataatatagaatttaagcttactactgttgatgaagaaaatcctaaagaagcgaatatgagttttaaattaacggatattgctaaaaattatgaaagtaagaatttaaatgatacgattgtattagatggtcgcggtgaaattgctttacaagcagtaaatattacaaaaaagctggagcctgctaatccggttggtttatatacttattatcaagttcaaaatgatggaaatagttttgttgttttgactacttcgataaaaaatatttcagaaagtgacatcacagcatctaatattgctgtagctaaattggttgataaagatagtaatgaatatccagcaaattcattttatgaaaaagatgatcgtagtaatttagctagtgccagcactactgtattgactccgggtcaaagtgggatgattcattttgtttttgaagttagtgatgctgttgcaaatggggagaaatcagttagaatcacatataatggaaaagtatttattgttaatctttaagatctagtattgctagatctttttttgtgaaaagtcacgcttttttgtgaagaatacctaagtatatggtctttgcacgattagctttgaaagtattgtgagaccttaaagcaagtgctaaagtaaagtcatagaaagaaggtatttgagatgaaaaaatataatgtagtaattgttggtggtggtagtcaccgaaatccagatttaatggccatgcttgcaagtaaaaaagatgtatttcctttaaagcgagtagttctatatgataatgaagctgaacggcaagaaatcatgggacaatatggtgaaattttaatgagggaatattatcctgaattggaagaatttatttacactactgatcctgatgttgcttttaaagatgtagattttgctttaatgcaaattagagcgggacgtttgccaatgcgtgaaaaggatgaaaaaatcccattagcacatggatgtgttggtcaggaaacatgtggggcaggtggttttgcctatggattacgcagtgtccctgcaattattgagttagttaaacaaattcgtaaacattctccagaagcatggattttaaattattcaaatccagcagcaattgtagcggaagcaacaaaacgaattttccctgatgattatcgtatcttaaacatttgtgatatgccaattgcaattatggatgcttatgcaaaattattaggatgtcaacgtaaagattttgaaccacgatattttggactaaaccattttggatggtttactcatttatatgataagaagacgggagcagatttaatgccttctgttcgggagcaactaatggctggagaaatttttaaaaaaggttcagaagatgaacatgttcgcgaaaaatcatgggtagatacttataattttatgtcaacaatggtcaaggattttcctgaatatttaccaaatacatatttaaaatattatttatatcctcgtcatgttgttgaagaatcagatcctaattacactcgtgcaaatgaagtaatggatggtaaagaaaaagatacttataatatgatgaaagaagtaattaaactaggcgctttaaagggaactaaatatgaattagatcctaatcgcggtgttcatgctacttacattgttgatttagcaacatcaatagctaataatacaaacgatattttcttaattattactaaaaatagaggatgtattccaaatttagatagtgagatgatggtagaagtagcttgtcgggttggggcaaatggtgttgaaccactagctatggatccagtagatactttctataaaggtttgttagaaaatcaatatgcatatgaaaaattaacagttgatggattcttagaatgtaataaattgaaattattacaggcgttagtattaaatcgtacagtagttgatacggatttagctaaagtgattctagatgaccttattgaagctaataaagcattttggcctgaattcaaataataacactcccttactatatctctttatttgaattttgttgtagtaatagcgaagtttttaacttcgctattttatcatttattgcaaaaaatttttttgttatacttaaataataaaggacggatgaaaagatgcaattaaacgaattagtaaatcttcattttgatgatttgaatgaaagtgatttatatatatggaattatattaataatcatcgtgaagtatgcacaaaaatcacaattgaagatttaggaaaaaaatgtaatgtttcaaggacaacgatattacgtttttctaaaaaaattgggttagagggatttgcagagctaaaatattacttgcgcaatgaacagacccttgccgatgtaggattaggcaagacagtaaatatttatgcattatttgaaaatcacgctaaaatgattagagaattacaaaatcgtgattacaatacctgttgtcgtatgattgatcatgctaaacgtatttttgtagtttctagtgggacgattcaaagatcagtggcaaaagaattgtcgcgccaatttttgaaattaggaattattatgacattagttaatggtgatagtgaaattaatatgttagcacgagcaatcactgcggatgatttattgattattatttctttgacgggagaaagtgaatcggtaattagaattgctaaggtggccaagacagtaggaagcaaaacaatctcgattactaggataaatgctaacagtttatctttgctggctgatgaaccaatttatatcttttttggtgattttcctattgttttcgaaacagcatatacttcaccaacaatgttttttgcattaacggaattattgtttgcaaattaccataactatcaacaaaaaaagttatttcaacaaggaaatcaaaattatgctgaataactaaaaaacctgcgcttagtggtacaatcttgtatttagagctgatgaaacttaattatttcattgctcctttgaaaagattgatcattgatgcggaggtttttatttacttgactctcgttctactaagacaacaggaacaattgtatcgatcgaaccaatgtcttttccttgaatcatattcaatagaacttcacagcccttttcagcaagcatctttggattcctttcaattgttgaaattgagggggtaggtaaccgtgaatataaagtattatcaaatccgattaatttgacttgttcgggaactttaagatttgctcgttttagtgcatacaaggctcctaaggcagctaaatcactagaagcaaaaataccatcaatcctgcgctgtgtttttaaaaagtctgttattaatatttcagcttcaatttggcttggttcttttccttgagtttgtaagatataatttttatcaagtggaataccgtaagtatctaaagcttttttatatcctaaataacgctcttttttctcataatcagcggtgaaactagaaataaaaacaatatctctacagccttttttgatcaaatgttcagtggctaaaaaagctgcatgaatatcatcactagaaattcgaggaatagttttattattttcaggatagcgatctatacatacaatgggaatgtcattataaatgatgtcttctgttaatttatttaaaccactgatacaaataatgccgtcgacacacttgcttgctaaacttttaaaataatctttttctttttgaacattatttgcactattacaaataaaaacagagtagttatgttttgctgaataattttcaatatgtaatgctagagtcgcaaaaaaatcattgctgatgtctggaacgattaaaccaatcgtctgtgatttcgattctctaagacttttggcattcatattagaaacatagccatatgatttagctaaagcattaattttttcttctgtttcttttgaatatccgcctttattatttaatactctggaaacagttgcaatgctaactccagaaattgcagcaatatctttaattgatagtttttttttatgattatccatgttatctccttgcttgttaagattatataaattatacatgaataggctatgaatgtaaatattagcaggttttattaatttttacgtaaacgtttacgtaaaaatgttgacatttacctatttgtatggtatttttaatctaggtaaacgtttacttaaagtgatggcgccgttatttttttaccagttaggttaaacgtttacgcaaataaatgcaagaaaattgcatctaaactataagagaggaaaatagtagaatagagatcattctggctaaggaaagggtttatggattttaataagatggcagctcaaattattgagcatatcggtggtaaagcaaatattgcttctttaactcattgtgcaacacggttaagatttaaattaaaagatcaaggaaaagcttcaaaagacaaagttgttaaaattgagggagttattaatgtagtagagagcgggggacaattccaggttataatcggtaatgaggttgcccaagcttttgatgcaatcgaagcattgacagggatttcaggaaaagaaattgatgtagtggaaaaagatgatttaaaggtaaaaggaaaatttattgatcaagtaattgaattagttacaggaatttttactccaattttaccggcattgattggagccgggatgattagggctttattgatgtttgctactagcattttaggaatgtctgctgaaagtggtttatacattgttttaaatgaagtatataatgcagtatattcgtttttaccaatttatttagcttatacgtcagctaaaaaatttaaatgtaatccatatattgcagtagcaattagtttggctttagtgagtccaacgattcaaggattggttcaaggtgaaacagggatgaaaatgtttgggtttgatgtattattcccagctcaaggttatggttcttctgttgttccaattattgtaacaatatatttcatgtcaaaattagaaaaattgtgtactaaatatattcatgcagtagctcgaaatgttttaacgccattaattactttattgattacagtgccattaatgtttatgatcattggtccagtaacaagttatttacaatcatttatcggtgaaggctatacatggatctataatttaaatccaactatttgtggaattcttttaggtggattatggcaggtattagtagtttttggtttacattggggaattgttccacttggacaaataaatttagcaatgtatggaagaaatactatcaatgccgtgactggtccaagtaactgggcacaagcaggtgcagctttaggtgttgctttaaaatcaaaaaattcacaaattcgacaaaatgcaatgtcagcagcagtaactggattcttctcaattacagaaccggctatttacggggtcaatttgaaatataaaaagcctttctatattgcagttggatgtgcagcagtttctggtgggattgctggatttgttaatgctgcagctttagcggggggaccagttggagttttatcattcccattattttttggtgaaggatttgtaggattttgtattgcaatggtatttgcatttgtcgcttcagctgttttgacttatctatttggatacgatcgcagtaatgattaagaaacatttaggggagaaaaaatatgaaaaaactattatgtccatcaatgatgtgtgctaattttggtaatcttgaaaatgaaataagaaaattagaggaaagtggaattgatatttttcaccttgatgtaatggatgggagttttgttccaaattttggaatgggactgcaagatattgaatatatttgcaaaacagcaaataaaccttgtgatgttcatctgatggtagtaaatcctggggcatatgtaaaaaaatttgcacaattaggggtaaagattatatatgtccatcctgaaagtgatgtgcatataactagaactttgcaaatgatcaaagatgctggagcgcaagctggaatcgtagtaaatcctgggacatcttatgaaagtgtaaaagaaacattatcgcttgtcgattatgtgatggtaatgagtgttaatccaggttttgctggtcaaaagtatttaaattttgttgatgataaatttaaacaattttgtgccaaaaaagaagaatttggctataaagtgatgattgatggggcatgttcgccggagcggattgctatgctgtcaagtattggggtagaaggttttatcttaggaacgagtgctttatttggtaaagagaagagttatcaagaaataattaaagaattgagaggactataaaatgagcgatgtaattagactaattagtgcttcaggcagtgattttgaaaaaatgacaccgatggaattgaaagaatcaatttttaaatcagaagggcgggtaatcatgggacagcatttattatttgctggtgaaggattagttagaggaataactaattctgaggtgatgtttgcttttggtgctgatatggttatgcttaatacaatggatttagataatatggaaaataataaaggacttcaaggattatcttaccaaaccttaaggcaacgttgtaaaaggccacttgggatttatttaggttgtcccaaagcgggatttgaagacggtggtaaaaaagctttatatcgccgtgaaggaatgctttgtacacctgaacatgttcaaaaatgtgttgacatgggagttgattttattgttttgggtggtaatcctggtagtggaacttcaattaatgacgtaattgcttgtactaaatggatcaaggaaaagtatggtgatcaattattcgtctttgctggaaaatgggaagatggtataaacgaaaaggtgctcggagatcctctggctaatcgagatgctaaagagataattaaagaattgattgatgtgggagctgattgtattgatttaccagccccaggaagtagagcaggcatcagtgtcacgatgattcgggaactagttgaatacattcatagttataaaccaggcactctggcaatgagctttttgaatagttcagttgaaggggctgacccagatacggtacgcttgattgcgttaaagatgaaagaaactggtgctgatattcatgctattggtgatggtggcttttcgggatgtacttcaccagagaatattcaccaattgagtatttcaattaaagggcgaccttatacatattttagaatggcaagtgttaataaataggtgaaaataatgggattatttaataaatggaagaaaaaagtagaagttgaaccatatcgtattagtgcaccagtagctggaaaagtaattgatatcaaagatacaaatgatcaagtatttaatagtgaagcattgggaaaaggagtaggcatcatagcatcagagaaacaaataactgccccaatcggtggtcaaattgtaagtttttttcctacaaaacatgcggttggaattaagacggataaaggtgtagaattattgattcatgttggaattgatactgttgaattaaacggtaaacattttatctcaatgaagaaacaaggtgatacggttgtacgtggcgatattttactaaaggttgattttgatgcaattagagaagctggttacgatccaacagtcttgatggtagtgacaaatactgctcaatatgcacaaatcaaatgtaatttaggaaataaaagtaataatgatattattattgagatagaggagtagaaaatgaaaattggaattggaaatgatcatgttgcagttgaatataaaaatgtgatcagagagtatattgaagcaaaatatggctatgaagtaatcaattatggtactgatagcagtgaaagatttaattatccagtttctggtgaagcggtcgctaatgcagttgtaaatggtgaggttgataaaggtatcgtaatctgcggaacaggcgtaggaatttctttggctgccaacaaagtaaatggaattcgctgtgtgacatgtagtgagccatattcagccaaattatcaagagagcataataatactaatatgctggcttttggcgcacgagtagtaggaattgaacttgcaaaaatgattgttgatgcctggttaactggtgagtatgaaggtgggcgtcatcaagttagaattgatatgctcaaagatattgaagtgaggcaatgtaagtaagatgtcattagaaataattcaaactttaaatcctgaatatacaatcaaaagtattactgacgaagcttttagaacttatggtaaggttattgataataatattgatgaagcaattgaattttgtatagactttgttcaggcagctaaacaagataacttttatcttcctagcgttttagaagtagaacaattgtcttcgattattgagctgtcacatcgtgtttatggttatttagaaataattgcaggtattgtcgccggtgataatgttgaattaagtggaattgaatatcatcaaggaagtgaaacaattattgcagtcactgattatattttagtagttgggcatatatgggatatgcaagatgacacatataatagttctaaatgtgaacttttctatgttccgaaaggtacgatcgttgaatgttatagtgctactttacattacactcctatagcggttagtaaagaaggctttataactatttgtttattattaaaaggaactggcgatattttagaaaagcgtaaaaagattttaaagaagaaaaataaatggtttattgctcatcaggataacctagaaaagattgcctcaggggattatccgggtttattaggcagaaaaatcataattgatcattaagcaagatttttataatcttgcttcttttttatttgtgaaatttcatgttaaaatgtgataatgggctattatcttaacatcggtacaaacagccttcaaaatattgtaagcgcttttaattattgttaagataggcatatagggacctatacattagaaaagtgaggagagtttagaatatgatgcaaaaaattcaaagatttggtggggcgatgtttacaccagtcttgttatttgctttttcaggaattgtcatcggtgtttgtacagtattccaaagtgatgtcatcatgggaagtattgcagcatcagacactacttggtttaaagtatggtatgttgtaaaagaagcagcatggacaatctttagacaagtcaacttattatttgttatttcgttaccaattggtctagctaaaaaacaaaatgctagagcatgtatggaatcatttgttttatattgtacttttaattatgcattagcagcactattaagcaattggggttcatttgtaggaattgattacgcaattgaagctggtagtggtacaggtcttgctagtgtagcaagtattaaaacgttagatactggaatggttggtgcattgattgttgctggtgttgcagtatggttgcataaccgttatttcgatacaaaactgcctgaatggttaggagtatttagaggttcttcgtttgtggcgatgattggttttcccgtaatgattggattagcagttattttcttctttatttggccacaagttcaacatggaattgctggtgttcaaacatttattattagcagtggcgccttaggggtatgggtgtatactttcttagaaagaattctgattccaacaggattacaccattttatttatatgccgtttatgtatgattcagttgcaattgaaggcggaatcaaaactgcttgggtagcagcaatgccagaaatcgctaaatcaacagcttcattaagaacattgttcccagctggtggttatgcattatatggtttctctaaaatgttcgctccactaggtattagtgcggcattctatgcaacagcaaaagaaaacaagaaaaaagaagtattaggattaatgattccggttactttaacagcaatgtttgcagggattacagaaccaattgaatttacattcttgtttattgcgccggtaatgtttgcagtgcattctgttttggcagcatcattagcaacagcacaatatttaattggaattagtggtgactttggaagtggaattatttctaatgcggccttgaactggattccacttggatcagcacattggcaacaatatttattatcagttgtaattggtctagttttctcaggaatttggtttattgtatttaaatttatcattgaaaaatttgattttaaaacacctggtcgtgaagacgatgatgaagaagttaagttggtttcaaaagctgaatataaagcttctaaagaggatacaagcaatgatccaactggaaatattgaagttaaaggtggcgatgctggtaaagcagcagctttcttagcggcattaggtggtaaagataatatagaatcagttacaaactgtgcaactcgcttaagagtatcagttaaagatgaaacattagtacaaccggttggagtctttaaaaaggctggtgctcatggtttagttgctaaaggtaaagcgttccaggttatcgttggattaacagtaccttatgtaagagaagaatttgaaaagttattataaaaaggggagaagaagaatgaaaaaacaatcatctatttgtattgctggcggtggaagtactttcaccccaggaattgttctaatgcttatggaaaatcaagaacgttttccaattcgtcaaattaaattatatgataataatgcagagcgacaaaataaattagctgaagcattaggaattttaatgaaagaaagatatccagaagttgccttttcttggacaactgatccagaaacggcatttacggatattgatttttgtatggcacatattcgtgttggtttatacgcaatgcgtgaactagatgaaaaaatcccattaaaacatggtgttgttggtcaagaaacatgtggacctggtggtttagcatatggaatgcgttcaattggtggtgttttagaaattttggattatatggaaaagtattctcctaatgcctggatgttgaattattcaaatccagctgctatcgtagctgaagcaactagaagattacgaccaaattctaaaattattaatatttgtgatatgccaattggaattgaaagaaattttgctactattttaggcttagaatcacgtaaagatatgattgtaagatattatggtttaaatcactttggctggtggacatcaattactgataaagaaggtaatgatttaatgccaaaaattaaagaacattgtcgtcaatttggttatgctgttgatactgaagattttcaacatcgcgatcaatcttggattgatacttatactaaagttaaagatgtatatgcggttgatcctgatacattaccaaatacttatttaaaatattatttatatccagattatgtagttgaacattcaaataaagaatatacacgtgctaatgaagttatggatggacgagaaaaaagagtatttggggcagctgctgatattgtagcgaaacaaactgctaaagattgtggatttagtacggatacacatgctgcttatatcgtcgatttagcttgtgcaattgcttttaatacaaaagaaagaatgttgttgattgttcctaacgatggtgcaataattaactttgacccaacagcaatggttgaaattccatgtatcgttggtaatgaaggtgctgaaccattaaaaatgggagaaattccacaattccaaaaaggtttgatggaacaacaagtatcagttgaaaaattatgtgttgaagcttggatcgaaggaagttatcaaaaaatgtggcaagctttaacattatcaaaaacagtaccaagtgctaaggtagcaaaagaaattttagatgatttaattgaagcaaataaaggatattggccagaattaaaataataggaggaagtgaaaatggtgtacggaaaactacaatcaatatttaaattttttaaaggaatgagtgccttggatattgtaaaatatctatttgtgggtattcctatcttgattcttggattcttgtatttatttatggcccaaggggatattgaaaagatgtttaatgaacctttgattgtgggacaattattactcgttctagcaatgccattttgttatcttgcaatgcgcaatatctgtcaagatcttaaagatcgaaaaaaacgtgatggattgttaattccgttatggatcttaattgtctatcaagttagttcatttaatatgatttgtagttttctcatcatttatggtactttccaagagtatggtaaaggaatgtttgcaataaaaaaattcactataaataatagtactaaagcgatgttagtgggattgattccgcttggtatgttgtacggattagttttatttgttaaaattagattaggaatactattctaggaggaatcaggaatgttaaatttgtttaagaaaaaaagtaaatcagtagaagtattagcaccactaaccgggacgacactttcaattgaagaagtgccagatcctgtcttttcagaaaaaatgatgggggaaggaattgccatcaagcctactacagatacagttgtagcgccgtttaaggggacagttaaaatgttaatgcctaattctggacatgcagttggtctgttgagtgaggatggtctagaaatattgatccatgtggggatggatacagtttcgttagaaggggaaggatttgaagttttaacagaagttgaagctaaagtagagccgggtgatccattaataaaattcgatgaagcatttttgaaatcaaaagagatggatactcttacaatggttgttgtaactaatcctggtgattttcaaccggagcagttcttaacaaataaagaggttaaagcggctaacgatccgatcatggtttataaaaaataatagaaaagtattattggttaaaaactgatcatcatttggtgatcagttttttagttagctattttaatcattagtgtactggagtatactgtagatatttggagggaaaataatggaagggaaaaatggtttaatgacacatggcaatattgcaaaacagctgatcgtgtttgcgataccattattggttggaaatttatttcaacagctgtataatacagtcgatagtatcgttgtaggtaattttattggtgatcaagctttagcagcagtaaattccagtggaccaattattgatatgctggttagtttttttatggggttatcattaggtgccggtgttttaatttctaattattttggagctcaagattgtcagggagttaaagaaggtgttcatacagcaatggctttagcgcttgtttcaagtcttatcacaacaatagtcggagtgattttcaccccaataatcttaaaatgggtaagagttgattcatccgtaattgggcagagcattatttatttacggatttattttttaggagtaattggtttaattatttataacatgattagtggaatcttaagagcggttggtgattctaaatatccattatattttttagttgtttcatcgattgtaaatattattttagatttggtatttgttgtaatttttaagatgggaattgctggggtggcgattgctactacgattgctcagatcactagcgcattattatcaatttatattttagtgagatctaaagaaatgtataaactagaattgcagcagattcatttttatcccgatattttaaaaaagacagctaagattggaatgcctagtgcaatgcaaaatgcggtagtttctttttcaaatattattatgcagtcaaatattaatgtgtttggtgcttatgcgatggctggaacaggttcatatactaaaatcgatggatttgctatcttaccggttttaagttttgcaatggcattaacaacttttgttggacaaaataagggtgcacaagaatatgaaagaataaaaaaaggggcacgtattggaactttgatcagctgtgggatcattttgacactgacaatcattattgtttttacaaccccgtatttattaagaattttttcatcaaattcccaagtaattgaatatggacgaacgatgatgttatgtattgctccaggctatttatttttaactctatcccaatgtatttgtggtgttttacggggtgttggaagaaccaatattccaatgtttgttctaattgggtgctggtgtatttttagagtaatctgggttacagtaacaactaacattttccataacattgtttttgtaaatttaggctggccagtttcttggatttttagttcgcttgtattaggcatatattattataaagctaactggttatatgactaggttcttcttttttgaagaatctttttttgtaaaaaattagcacttgtattgacaaagtgctagaaaaggatataataattttagcacttaggaatggctagtgctaaaaaggagtgattaaaatgattaagccattacatgataatgttattttgaaaaaagatgaagtagaaaataaaacatctagcggaattattttaacaaccgaaacaaaaaagattcccagtgtagcaacagttgttgctttaggtcctgattgtaaatccgaaattaaagaaaatagtaaagttgtttacaaagaatattcaggaactaatattaaaattgacgaagtagattatattgtcatcgaagaaaaagatattttagcttatattgcttaggaggtaattagaaatggcaaaagaagttagattttcaagtgacgcccgcaagtcaatgttaaaaggagtaaatactcttgcagacgctgtatgtattacgttaggtcctaaggggcgaaatgttgtgttagaaaaaagttatggttcaccattgattactaatgatggtgttagtattgctaaagaaattgaattagaagataaatttgaaaatatgggagcaaaattagtatatgaagtagctaataatactaatgatgttgctggtgatggaacaacaacagcaactattcttgctcgtaatatgatcaatagcgggatgaaagccgttgataaaggatgtaatcctgttctaatgcgtgaaggtattgaatatgcgagcaaagaggtagcaaaaactattttgaagaattcacgtaaagttgaaactagtggagatgttgctagtgttgcaacgatttcggctggtagtaaagaaattggagatttaattgctgaagcgatggataaggttggtcgtgatgggattattaatgttgatgaaagtaatggatttgataatgaattagaaatcagtgaaggaatgcagtatgataaaggatatgtttcgccatacatggtttctgatcgtgaaaaaatgcaagtcgaattagaaaatccatatgttttagtaactaatcataaaattaataatttacaagaaattttaccagtacttgaacaagttttaaagacaaacaaaccattattattgattgctgaagattatgaaaatgaagtaatttcaactttagttttaaataaattacgtggtactttcaatgttgttgcaactaaggctcctggttttggtgataatcaaaaagaaatgctgcaagatattgctgcattaacaggtgcaaaactttataataaagacttaaatatgaagttggaagaacttcaattagaagaacttggtactattaaaaaagttattgtgactaaagataatactactatgatcagtggtaatgaagaaaatcctgagttaaaggcacgaattgaagaaataaaaacaagagttgctagcagtactagtgattatgataaaaaacaattccaagaacgccttggtaagttaacaaatggggttgcaacaattaaagttggagcgactactgaaagtgaattaaaagaaaagaaattacgtattgaagatgctttaaatgctactaaagcagcagttgcagaaggtattgtaattggtggtggagcagcattagttgaagcttataaagaattaaaaccagtgcttaaaaatgataatgttgatgttcaaaaaggtattaatatcgtgatggaagcattattatcaccaatttgtcaaattgctgaaaatgctggatataacagcgaagatattgttgatatgcaaaaatctgcagctaaaaatcaaggatttgatgccaaaaatggtgaatgggttgatatgtttgataaaggaattattgatccgactaaagttactcgtagtgcattattaaatgctgcaagtatctcagctttatttattacaactgaagctggtgttgcagaaattaagtctgaaacaccagaggctccaatgatgccaaatcaaatgtattaataaaaaaggttttgtattgattttaaatacaaaacctttttgttatattttttcgatttcatcgatccagttacttacgtttgcatcacttggcattcgccagtcaccacgaggagagagagagacacttccaactttaggaccatctgggatacagctacgtttaaattgttggctaaagaaacgccaataaaatttagttagccatttcttaatagtttctttgtcgtatttatctttaaaagctagtttagttttacgatatagtttacgtggttcatcaccaaaacggaccatatgataaataaagaaatcatgcagctcatatggacctacgatatcttcagttttttgaacgatctgatcattttcttgaggtaataactctggtgaaacaggtgtatctagtatatcttttaagattgtttctaatttttctccatgatacaaactagctacgtaatcaactaaataacgaactaaggttttaggaacagagacatttactgcatacattgacatatgatcgccattgtatgttgaccagcctaaagcaacttctgataaatctccagttccaatcacaagaccaccaacttgattagctttattcatgagaatttctgttcttgttcttgcttgaacattttcataagtaacatcatgaatattttcatcttgttcaatatctctaaattgaatacggacagattctgtaatatcaacttcaatacttgttacagctaattcttccattaatcctaaggcattgtttttagtccttgaagtagttccaaaacaaggcattgtaattgcaataatatcctttgtatcataatttagttttttgaaggccatcgtacatactaataaggctaaggtagaatctaacccccccgaaataccaataacgacttttttgattccggtggcttttaagcgctgcattaaacctcttgtttggatatcaaatacctctttacagcgtttagcccgtaagtctcgattactagggacaaatgggtggggatcataataatatgtggtatttaaatcgatatttgttgaatcaaaataaatagtttcataattatgatatgatttaaaagttgtcatttttcgacgttcacttgataatttctttaaatcgagatcaccatagatcagttcactgtcaaaacctcggctctctttgatcattgttccattttcactaataatgtgatgcccactaaaaacaacatctgtggtactttcgccattaccggcattacaataaacatagccacaaactaaacgagctgattgagaacttactagtaaacgacgataatcgctttttgttgtaatttcattgctggcagaaggatttaaaattaaattagcaccatttaaagccagtttagtacttggggcatctggtaaccaaagatcttcacaaatttcaactccaaatttaaaatctgaattagttgttgaagcaaaaacatagtgagttccaaaaggtatcttttgaccattaaagtttgtcaatgtattttcttttggggcttgttcaaaacgacgggcttcataaaattcctgataattaggaatatgtgttttagggactaaggcaagcagcgccccttgatgaattactgcagctacattataaagactatttaaatgttgataaggtagaccgacaatggtgattaaatctttattatttgttgcagtgataattgtttgcagttgctgtttagcctcatttaataagcgatcttgattgaaaagatcttcacaagtatatccggttaaacaaagctcgggtagaactaaaactctagcatcattatgataagcttcattaattaagttacaaatattttcactattattttttacgttagcaatactagtttcaaaagaaccagcagcgacacggatgtatccatctttcattatatctcctccaatgactatattgtacactgataaatgtttctaaacaagctgaaaaaagtaatctaattattgactagattacttttttaaaaccatgaccttttcattttttaaatcaagttcgtcggtgaattggaagccgcgcatttgatataaagaagtggcagcttctaattgtaaaacgattttgcgattttgttcatctacttttttatgattgtcaaaatttcccaccatatttataatattaataattattgcatttcatgattagattattcaacttttttagtaaacttgaatttaaaacataagatcaaagcaattgtaattgaagaagcaaaaattagatacataatggtatagccattatttcctgggaaaatatctaaaactcgacctccaataatttgaaaaatcaaagctgaaaagcctttggctaacatcgatgaaataccataggcactattgacatattgttcatcaactaaatctaatataattcttacagcaacaagaataaaaacaattgttgttagaccttgaaaaaagaaaacagacataatcaaatatggtgctggacaagttgaataccagacaaagcgaatgatagataaaacacaggcaaatatcattaaagctttatatgaaatctttttcatataacgatctgaaaataagacagcagggatctctgataaggtactaaataacagagtcgttcctacaatcgtagtagtccctcctaaacctttgattactaatgggaggtaaaccatttgggcagaacttgggccttgaaaaagaatatagattaacataaaaattttaaaaggtttgttgtgccataaatgttttaaaacttctttagttgttaccttggctgctttaccaacgataagcggtttagcatcgtgcatcatataaaaagaaaacaacatgagcaatagaccagctgcaaaaatatagaagtttgcagttggtgaaatatagtcataaacaataccgcttacctgagcagcaatagcataaagaatagatccccaaactctgattgctccaaatggatatggtgaggcagtagctaaacgatctgttaaggcggtaattccgtttaaacaaccttgagtgaagccgttcaataaaaataaaaagataaaagactttgttgaagcaaatagtaaaccaaaaataattgttaatgcaccagttataattgcgactagttttggacttttaaatttatcagctagaaaacctgtaattggttgagtcgccattgcaaacaaagccgcagccgaagtgattaatgaaatttcagtagccgagcagtttattccagcaagatagacagaaatgatacaagaaaacattgcccatgaaaaatagaacatcccatttcctaaggcgtagtagatataacttccctttttgaacatgtatgaccctccaaatattttttgatgcttcgattttatcactgaaattttttaagtaagcgctttttcattttttggaaaagaatatctagaatccggtataagagctatattttttacaacatagcaccagacaagtaatttgttgaacttggaagaataatggtttataatgaaacaggtttggagggtttcaatatgagttttgaaatgttatcagatttagggataaaaaaatatgaaatgtgtcgtgatgatattgggcgcttctttgctcgttcagtagttgcgggattatatttaggattagcgacgatcttatcaacaacattaggaacattgctatttaaagataatttaattgcttcaaaaattgctgtagcaggttcatttggaatcggattagtaattattgtaattttaggatcagagttatttacaggaaattgttttacaacaatgattcctgtttatggtaagaaattgaagtttcgtcagataattcccatgtggatagtttgttattttgggaattttgtaggaattgcactagtttgttatttattttttattagtggtagtaatcatgaactgctttcggaatatgttgttagttgtgcaaatacaaaattaagttttgatatcattgaattattagtcaaagcagttttatgtaactttatcgtttgtgtaggtgcttacgtagggatgaagatgcaggacgatacggccaaaacaattattatgatgattgtggttatggcatttgttttacctggattcgaacatagtattgctaatatgggttctttcactttaacgataggggctttaggaagtggtgctaactttggtttgattgctatacatatgatcgtagtaacttttggtaatatgattggtggtggagttttgttaggattaccactatatctaatgattaagccaaataaataaaaatctatgataatgaatttatgattcattattaatagatttttttatttgcatttattacggttttaaatttttgttcgggaataaattatatcaatatcaaaaatacctaatcgatcagctttattaatactaagaataacatcataatcatctttgttgataaaagtacgataacatagaggtgttaattgattggtagaaattgtatgttttgatgattatttttaagtatcagtatagttaattgctcttttaaaatgtgcctatagagataaaacgctcatcttcttcaataatactagcttgatattgataggaaattaattattttggtgaagctagtccaattaaaggattaaatttttggtaacctttattttacctgaatataggaaaatagttaatttaagattattttgtggtgcatacatacacaatttctactgacagtcatcaataactcttttattttaaaaaaaattattgcctaagcgattgaacttgattattgatgttgacaaaactgtggtttatcgataaaatttttatacatgattaaagcaagaatagacgttgtcaagaagataacattatgccatgaaggtagtagactgttttgaaaaacaggtatttttatggcttttttcatgttttataaggagggaaaaatgaaaaatttaagtgttagaaatatcgttttagctggttttttcttggcagtaggaattgttttaccgttttttacgatgcagataccaagtatcggcaatatgttgttaccaatgcatatcccagtattgatttgtgggtttgtttgcgggtggccgttaggattaattgttggttttatcttaccattgcttagaagtatgttatttacaatgccgccaatgtatccaactgcattagctatggcttttgaattagctgcttatggagctttaacagggttattttataatcgtttagctaaaaagccgctcaatacttatattgctttaggaatagcgatgattggtggaagagtaatctggggaattattagtgcaatattatatggaatggcaggacagccatttggatttgcaatctttatagctggagcttttaccaatgcaattcctggaatcatattacagctgatcgtgattccaatattaattatggcattagaaaatgcgcatttaattaaatataataatgattagtgcactcgttacaactcagctagagaaatatccccaaatgaaggctcaggatattattaaattgatttatcaaaatgaatttggtggtggtcatatgattgatgatcctgagactagtttaaagcgtttaaaagatgaggcaaagcagttaaaaaataatagttttattgaagaagacataggaaatgatttggttcgtgtttacttaggaaatgctggtgaattagaactgcttacattaaatcaattatttgtatattctgctaaactaatgaacgggagtattatttccttcattaataagttagagcaattaaagagtgcttgtcaaagagggacaattagttttgattataggcaaatttgtttagaaatcgaaaattacgagaaacttaattatcctcctattagtcattcatcaacatatcgggaactatatcagccacattatcgagttattaataaacagatttatagctattttcccgtaattttaaaaattaatcaattattgcaaacaaccgatcgtttaaatattgctattgatggaaaatgtggtgcagggaagtcgacccttggtgaaatgattaaggcaatttttgaaacaaatctttttaaaatggatgattttttcttacagccttttcaacgaactgctgctcgtttaaatgaaccgggtggaaatattgattatgaacgttttaaagaaacagtaattgttcctttgcaacatcaggaaagcgttaaatatcagcgttttgattgttcaaagatggctttagaagctcatgtagaattaattccatattctcgctttaatgttattgagggaacttacagtatgcatccgtattttggaatgttttatgatttcacgattgctttgaatgtatctgatgatattcaagctaagcgtattttaatgcgtaatggtgagatgatgtatgagaaatttaagaaaatctggattcctttagagaataaatattttgatcaatataatatttttaatgttgcggatttgcaatattatagtaattaagcagcaattttaaggaaataaattgctgtttttattttgtgaaaaagccttattaaatcaaaaaattactgattacttttagcatatctgtttaaaaaatgtttgtttaatgataaacttaaataagaaagggtgatagtaatgcctaaaaatatatatgtactttctgaccttcatggccactacaatatttttatcaaaatgttggaaaaaattaatttttctgatgatgatgttctatatattttaggggattgttgtgatcgaggtccagatagcttaaaaatttatttatatattcaaaaatttgataacattcatttaattaagggaaatcacgagattatgatgcgtgatgcttttaaagttgatgaccctgcttcatcacaaggccggatgtgggctcaaaatggtggaaataaaacatttcacagctaccatgaatatttacataaaaaagcatttaatgactgtgattataaagtaattaaagcggcgttttataagatgatgattgattacattgaccgttgtccttcatttattgaactgaattgtaatggtcaagattatgtattgattcatgcaggaatcaatcctgaaaaggggttatatgaacaaactgaagaagaatgtgcatggatgcgcgagtatttctttatgtcaaaaggtttggataataagattattatttttggtcatacgccaacttgttatattcatcaggcaagtggctgttttgatgtttggtatgatccggtttttaaagataagatcgggattgatggcggtttaggaccatttgataaagggcagctaaattgtttatgtttaaatactcaagaagtatttgtaattaaaaaaagtgaattggctattcaggaatagaaaaaactctaattttaaaattaataagagtagaattaaatcaagggaggtattttatgaatttattaataagtagaatattaacgtatttaaatgggacattgctttatgattcacattatcgtttttgtaaattcattgtttatcattacttagaattagaggatttatctttcaatgaagttagtgaaaaaagtcaaatcagtaaagaggatattttaaggttttgtgctttgcttggttttgatgattatgatacatttaaagccgaactgttgagatcacatatgattcgtttagatcagattcgggctcgaatgcttggggttaatagtgagcagctgattgatgaaatggaaaaatcttgttcgaatgaagtaatgagtgaatatatctcgactatttgtgaagctatctttaaagctaagcgtgttgttttaataggagctttatatccgatgtctattgcagtagaatttcaaactgacttagttagttttgggaaaccagtaattcagtatcataattttgataaagatatccagcttgatgaaaatgatgttactatttttgtgtctgcaacaggtaggtcaatgaattcatttgttgaaataaaaaaagaattacgggttgatttaacaacatctattttaattactcaaaataaaacatatgctttagatgaatataagatttctgattatgtaattcaagtaccgggaaaatttgatggaatcaattttaattatcaaattatgactatttgtgatttattaagagtacattattatcaacaatactatttgtaaaatgaataataatttatctttttttgttaattattaaaagaggatttccaaaatggagatccttttaatctatataaaaaataaaagactgttttacagccttttatataataattaatttttatttttaaatccatttatatcttttttaaatcactatagttaattaattgaatgttattatccttaataaagtttttcatttcttcactacgtaataatgccaattctttcattcgtggtaagcaataactagtcatatcgtataaacgttgatcaacatatgcaggatgacacatatattctaaagtttcttcatcaactttcattgaattagacataaaatcataagtgatcaaatcatcatacatttgatcattacaacgtacatattcataattatcaatgatttggtcccgttgtctgatcggtagatcatattctcttgctaatttaattaccacttcttgatgttgcggtaatagatgaacatggtgatgagagtcaatatgagttggttttttaccagctatttcaatgaatttctctatttgagctttccactctgtgtataattcttcaggatcagcatggggttgatgatctggatagtcttttggacgaataaagttaccatctttatcagtataacttttagcaccatctactaatggtctcccaactgttaagactaagtggatcccaacacctaaatctggataatttttagcttgatctaaagcaaatttagcaaatggcatattcatcatacatgtagttgatgtaagaattccatcagcatgtgccattaaaataccaattgaatttccttcggtcataccaaaatcgtcagcattaacaattaatttttttatcatttcatagtcctccgtatctatatctccattataggctattataaaaataatatatatttttttcaaaaactgcaaactttctgtcatccatgctataatacttttaaaaaatggagggagatcatgaaatcacaaattagtgcaacaacaagtttatatgcttttatcgctagtcctgcacatcattctaaatcaccagcgatgcataatacagcctttgaacaattaggccttgatagtgtttatttagcatttgatataaagagtgaggaattaaaagatacgattgctgggtttaaggcgatgaaagttagaggagctaatgtttcaatgcctcataaacaaaatattattccgtaccttgatgaaatatcaacagcttcaagattatgtaatgcagtgaacacaattacttttaaagatggaaaatattatggtacgattaccgatggaattggctttactagaagtcttgaagagcaaggatggttgattaaagacaaaaagataactatggtcggagccggcggtgcgtcaactgcaattatggtacagcttgctttagatggggtaaaagaaataatcgtttataaccgaactatgcgtacagagtttcaggagataatcaataatacaattattgaaacaggttgtacgattaccttaaaatctttaagtgatttagaaagtttgaaaaaagatatgcacagcagttatctttttatcaatactactggtgtcggtatggaaccgatgttagaacgatcagtagtaccagatgcttcttattttaaaccagatttaaaagtagctgatattatttatcagcctgcagttacaaaaatgctgcgattagcaaaagaagcgggttgtgcaacgatgaatggtgaattgatgctgctttatcaaggagttgaatcatttaaaatatggacaggtcaagaaatgccaattaatgaagtaaaaaaagtactaggaatcgaggtaaaataatgaaagaaataattgttgcttcaactaatcaaggaaaaatcaaagaaattaaagcaatgcttaaagatattgatattgaagtattatcgatgaaagatgttttagagcaagaattggaaattgaagaaacaggaacaacatttaaagagaatgcactgattaaagctcaaacaattgcaaatattgttaacaagccggtcttagccgacgatagtggtctagaagttgatgctttagacaaacaaccaggaatttattcagcacgttttttaggtgcagatactagttataatattaaaaatcaatacataattgatgcgcttaaagataaagagcgtactgctcgctttgtttgtgcgatggctttagttatacctggtcaagaaccaattttaattgaagaaacgatggaaggcttgatcaatgataaaattgaaggagctaatgggtttggatacgatccaattttctattttccgccatgtcagatgacttcggcaatgatgtcaatggaggaaaaaaataaatactcacatcgagctaaagctttaaaaaaattatatacgattttaaaggagatattataaatgaatcatatcgtattagttcatccagccattccccaaaatacagggaatattatgagaacgtgtgtcgctactaacactagtttacacattattaaaccaatgagttttgaattagatgataaaaaaatgaaacgtgcgggattagattatgttaaagatctaaatttgtatgtttatgaaaactatgaagagtttgaacaaaaaaatcctggagaatatcatttttttacgcgttattcacatctttgttacactgatcaagactttagcgatgataaaaaagaacattatttattttttggtcatgaacatgatggaatacctaaagaaattttaaccaagcatttagatcgttgtttaagaatcccgatgagtgataaagttagaagtttgaatctatcaaattgtgctgctatttgtatttacgaggttttaagacaacaaagttatccaaatctttcaaaagttgaagttcaaaaaggggaagatttcttatatgagttataataaaaaagacatttttttagcaacgatgttaatgttatttattatttcattagcaatagtattcactgtcttttttaaacagctgtattatttagatattaattatttaggaattgatttaacgagtggaatgtcagttgaaacaataaaaaagaattacgatgttttaattgcatatcagtcgatcttttatcggggaacgttgaatctgccagattttgtaatgtcaacaaacggtaggattcattttgaagaagtaaaaacaatttttgaggcaatccaggtaattatggtagttagtgggttgatctcattaccgttagtaattagacgatttaaagaaaaagaatatcgttttttaaagcttactgggctgattactattattgtaccagcaatgttgggttttgttgtagcattagattttgaaagtgcttttataacttttcatcaaattgtatttagaaacaattattgggtatttgattatcgtaatgatccggtaatcaatattttaccagaaaccttttttatgcattgttttattatgattgttataattgtaattactctagcagggttatgtttattttattattatcataagcaaaagcaaataataaacgatactattgaatagtatcgtgataatcatgaatcgtatattcaggctcttttaaaataataggagtcttttttttatctttcaaaattttaacaatgatactgataaacaaaaacatacttatcaataaaggaatcagtaaatagtcttgatgctgtaaatagtaataagataaaatggcggtagtaatgaaggtaaacagaggataataaagtggtaatgatttagttaaaatcttagatttttttaaatagtgataaagagtatcttgatcccataactcaacatttgtatttttagcgagattaattgcagcactgctaaaagtattgttagtgaagactactggaatatcgcactgatagtattcacaaccgctttttgcttcctgaactgctttgattcctactgttttgctgtaacgtttacattgtatagcatatgtatatttgtttttatatgcaaagacatcaattccgtaatcgctactgctttggctgacattcacttgtttaaagccgtttttttctaataatgttttggtgaaatactcaaaatcatgaccatccattgtattgatatattctaaatctaaattattaaagtaaatatttttaattattttatatattagtttaaaaagtatagtaattatttttaagggtaaaacaaaaattgtattaatgagccataagataattagtttcattgtcgcacctcgctagtcattatatcataaaattaaatattacaaaattgtaagaatattgtcatgaagttcgatggtttgtactattaaaatagattattatataagtgtaggaggtggcaagaatgaaaaatataaaagaattaattgctatcatcaaatttagttttcaattatattttaatcactaaaatagttgatttatatagatagcagttagactgtacaaaagaaactattcaaagcagttttttaatattaataataaaaagccctctagtaagggctttaaataattatcctaaaaagaaagtatttacttcaaagtgagcttgaggatgatcacaagctggacatctttctggtgcttctaaaccttcgaaaataaatccacagttattacatttccatacaactggtgtttctcttttaaatgtattaccagcttctaaagctgctaataattttaaatatctttcttcatgatgtttttcagcaattgcaatgctgtctaaaactgtagcaatatcttcaaatccttcttcacgagctgttttagcaaaacttggatacatatctgtatattcttcgttttctcctgcagcagctgcttttaagttttcagcagtagttcctaataatactgggaagtttccatcagtatataatgtttctccagctaaatctttattcattaatttcattaatcttttggcatgttctttttcttgatttgctgtttctaagaaaatattttgaatttgtacaaatccttcttttttagcgattgaagcatagtaagtatagcgattacgtgcttggctttctcccgcaaatgcatgcattaagttgttagctgttttagttcctttaagtgtcatagttagtttcctccgttattttctttaatttttcttttttaaacattcttcacatataccgctaaaaacaatatccgttttttcgatatgatgtttagtatgttcttgtactacattactaatgttttcatcatggtaagtgatgtcaaacacttgattacattcattacagataaaatgataatgatcactaatgtccccgtcgaaatggacgattgtttgaccaacatctaattttctgatcattttagcatcagctaaaaagttaagattacgataaacagttcctaaacttaagccggggttatctttttttaaatcactataaatagcttcagcagtaggatgatcgcatcttgcttttaaattttcgtaaatcaattcacgctgtttagagtatcttgtctttggcatacgctacctccttttctataatagtaatggttactattatagtatatcttttgttagtatatgtcaatagcttattgataattattattaataaaagaaaaaagtacgcttcagcgtactaatcttttaattctggaatgtatttatataatgcttcagcaataccatcttcatcattagataaagttatatattgactaatatcttttaagtcttgaacggcattagccatagcaacacctgttcctgcatatttaaccattgatgcatcattatgaccatcaccaaaagcaatcatttcatcttggctataacccattggttttaaaacagtatctaaagctttagctttatcaattccttgagccgtaaattcaaagtagaaaggaccggtaaacatacagcttagactatctttaaatggttccatcatttcttgatagtgttcttgaagatattcaggatcactagtagttaagattttattgatctcaaaatcagcaaaagctgctaaatcgtcaatctcacataacttatagtttccaccacgtgattcatattcaataacattgaatggtgcaccattgaaattaatatagttatcataaacattgttgacaaacatatattcacctttgtcaatcattggacgtacacgatcgaacttcttcatatgctctaagacagctttgccttcttcaatgctcaatggttgattaaataattcttcttttgtttggcagtcaacaactttactaccattataacatacgaataaaccatgatatttatccatttgtaattcatgccctaatccaataaggccagatgttggacgcccagaagctaaaattaatttaatacctaactcttgtgctttcattaaagctgctttagtttttggggtaacaattttttgactgttggttaatgttccatcaacatccataataattattttaaatttgctttccataatcattctcctctttacatctttctattatactgaaaatatttgtcgaggacgattctttttaataaatgaaaaaattatttcattaaaaataataagatggttaaaaaaatgataagctcataacagataagttaaaattaatagacataaggtaaatgaacaaagaccatgaaataagcgagctttgaaataagccttaaaactatagtcaattccatctaaaagattatccgtttgcatcattacactaagaccactaaaagatagattaaaacaaattaagctatatactagtggggtatgactaaattgtaatagttgaagacttccagaactaaactcaagaactccctgaataatagcattaatgaagctgtccttaataatatgaccaatagcatatcctacgaattgaaaaaccagcatataaccaaggatgaaaataaaagcataacatgaacttaaaatgctttgtttcaaagcttccacaaaactgacatggggcttttttagtctaatgattgattccttcaaactttgaaactcataatgctggtgataaaataaagctttaataatactaggtgctagatgacaaaaatatatgatcaatggatattcaagatgcaatgatacaaaaataaaggaaattgaagcaaatgaagcaatagataaaagatgttgtaattcttgagaattaatataatttaattcatatgcttctttgatcattttaacattagttggataaccacaaaaaaatgagatgaagtatatagaagacatgattggagataatttaaataatggtttaaagatccattggattaaatagctaaagagatttaataaccctaaagataaacagagtgaaataaggatcataaatggtaataatgaaggtaatagattattaataattattttaatcacattattagagagtgaaacaatttgaaacatgttaaagaatgaaaatagtgtaataaaggcaactaatagtaaagtaaaatagtaattgaattttttcatatgctttccttctagtaatataagattagataaggtaaaatggagtggggtgaaatgatgaaggcattaatagtcggtgttagatataaagaaatgaattatgatttagataattcattaattgaattagaggaattatgtaaagcatgtaatattgaagtgataaaaagatgtgtgcaaaatcttgataagattaatccttcattatatattggtactggaaaggttcaagaaattaaaggacagttagataatcttgacctagtgatttttaacgaagaattatcaccactacaagtaaaaaatttaacagatattttagatattgaagtaactgaccgaactgatctaattttacgaatttttgaagttcgagcgaaaaccaaagaagcaaaactgcaagttgaaatagctaaaggtcaatatttattgccacgtctagcgggcatgaaagaacatttatacagccagcagggtggttcgggattcagaggaagcggtgaaaaacaaattgaattagatcgtcgtttggtttcaaatcaaatctttaatgctaaaaagcaattagctaatattgttaaacagcgtcaaaatcaacgaaaaagacgaaaagacaatgagatgaaggttattgctttagtcggttatactaatagcggcaaaagtactttaatgaatgctttttgtctaaataaaaataagcaggtattgcaaaaagatatgctatttgcaacattagaaacagcgacacggcatattacgatcaatcagcacccctgtttattgacagatacagttggttttattgagcgtttaccgcatcatttgattcaagctttccgttcaactttagaagaagtagttgaagccgatttgttgattcatgttgttgatgcttccaaccctaattatgagcagtatattaatactactaatgcagttttaaaagaattagggataaaggatacgccgatgatttatgcatataacaaagttgatttaaataaatatggctttattgtaccgttagagccatatgcatttatttctgctaaggaacgtattggactagaagtattagaaaagtcaatcagcgatatcctttttaaagattatgcaatctatgatttaaatattccttatcaagatggtgaagtatttaagtatttacatcagcattgtttagtgttagaatttcagtatttagaaaatagtatttatatgaaaatcgaagctcatccaagatttatggtacagtatgatcaatatttattaaaacattaaaggaggttttgaaatggataatgaaaagaaattgtttcgcttagatctatcaattgctgtagaagcaacttcagctcaagaagcctttgatattttagtgacagacgaaacattaaaacaaattagagagttggtaatcaagtcgaaagataatattaaagaaatgtttgaaaaagaagatagtgaacctgcaataatcaattagttgattattgcttttatttttgttagaattaagaataaaattataaagggggatttataatggatttgtatggtagaaattttttaacacttaaagatttttcaaaagaagagattagatattttcttgatttagctcatcagctaaaaaaagataaaaaggaaggaaaaacgagtaatagcttagcgggtaagaatattgttttgttatttgaaaaaacttcaacgagaacaagatgtgcttttgaagtggcagcattagatgaaggggctcatgttacttttttaagtaattcacaaatggggaaaaaagaatcaattgaagatactgccaaagtacttggaagaatgtatgatggaattgaatttagaggatttgaacaaagtacagttgaagcgttagcaaaatattcaggaataccagtatggaatggattgacagatgtagatcatccaactcagactttagcagactttttaacgattgaagagcatttagataagccgcttaacgaagtgaagtttgtttttacgggtgatattcgtaacaatgtttgttatggtttgatgtatggagcagctaaaatggggatgcattttgttgcattagggcctagtgaactacaaatggatccggaagtagtagcctattgtaaagctgaggccgaaaaatctggtggaagttttatggtgacagataatgttgatgaagcggtaagagatgctgatgttatctatactgatatttgggtttcaatgggtgaagcagaagaattatatccacaacgggtgaaattattatcaccatataaagtaactcaggcaatgatggctaaaacaggtaatgatagaactttatttatgcactgtctaccttcattccacgattttgaaactactcttgcaaaagaaaaatacgaacaaggtattgatattcgtgaagttgaagatgaagtctttagaagtgctaattcggttgtttttgatgaagcagaaaatagaatgcatactatcaaagcagttatggtagcgactttaggtaaataaaaacggagctaaatagttccgttttctttggttttagatatattttcatttgtaatcatatctaataacccacgataattgtatgttgcataaacacttggtgtaacacagtgtactggcacggtatttttaacaatattcattgcctgtggttctaagtatgaaatttgtggtgctaggtaaattgcatcacagtccaaataactactatttaactgatagaagccaagaggaataatttcataattaaggtgttttaaggagattagttcagctagcttatttgcaaagaatgatgatgataaaccgcctgagcaacataaaattattttaagtgggggacattttgtatgtttggtcaatgaatcgtagaagtcgtaaaataatttttgtccttgagctaaactaacgagtttgtaatgaagatagaataataaattttcttcatcatcaaagatttgttcttcaatgataccattagcccaaataacaattgaaccactaatattataataattaaaagtgatagttttcccgtaaggttcattgctttttaatgtacatagtatattatgatcatacttatttttatttccaaataaccattgtacaaacaattcaagattaacgtccaaatagaattcgtcgaccataattatcccctccttacaaatataagtataatcaaaaataaaggtaaagacaaattttttctaaaatagtaaagcgcttacaaataaatcaagtgatattttaatgctaaagtatgatatgataagattaggtgataaaatgacgggtaaaacttatgtcatcagtgatctacatggtcactttgacttattgataaaattactagaaacgatatcatttagtgaaaatgatattttatatataattggtgatatttgtgatcgtggacctgacagtctaaaaatattattttatattcaagatcataataatattattttaataaaaggaaatcatgaatacatgtggcaagaagctttatattatggagtttattatgatgattttgattatccttcacgggcgttaaaattatggttagccaatggtggtgatacaacgatgagaaatattcgtgaatatcttcaaaaagataaatttagatatgaagattatcgtgttatccggacagctttttttaaaagtctgtatgaatatttgattaatcttcctaattatttagaaattgaggtaaatcaacaaaaatatgtgttagttcatgctggaatcgatgttcgttatccactaaaagaacaaaaattaaattctcttttatggattcgagatgatttttatcatgcacgaggtgatttgacaaagatttatatttttggtcatactccaacagcgatgttaaacaaggatcggagttttgatatttgggttgatgatgtccatcaaaataaaattggaattgatggtggtttggcttgtggtgtgattggacagttaaattgtttatgcctagatgatggcaaaattattattgttaataaggaggagtagggaatgcgcggagctttttataatttagttaattttattaatacaacgagcataaatgatgtttatgctaatgcagcaagaaaaattcttcaaaatatctatgtgattccgggaagtacaataactgatgtagcagagctttgttttgtttcaacagcaacgatttcccgattatgcagaaaactaaattatgaatcatttgctgattttaaaatggatattaccatgaatttaaattattttaatcgcgatacactcagattacagtttgatcatcagttgccccaaaggcagtatttacataaaggtaaagaagtgtttaaagctcattttgataatattttagataatttaaaagaaacatacgagagtgtatcttatgaagacctggaatttattgtcgataaaattcatgatgcaaataaggtttgttttgctggaaacttttttactcaatcagtatcgatgcaattacagattgaactatcatatttgggtaaagaatgtagtgggatgtatcctttagaacagcaaattttgacggtagaaggattagatgaaaatgatgtaattattgtttcaagtattgcaggaggatttatgactgatcatccagatgttatgcgagtaatttctaagagtccggcctataagattgttatttctcaattggatgaatttgtttatagtgatagtatcgatatgatcttaaaggttggaacagatcatcattcactgattggtaaattttcaataacctatatttttgaggttttagaagccctgtatcatttaaaatacggagttaaagaaaaacgggaattataaaaaaaggactaccatttggtagtcctaaatcgtattataagcccacatagctttgatttgaggagctaattggctatatgaccattgcttatgactattttctttactgttaggatcattaactaaaaacttgtcattaatagttttagtaatgacaataaagtgaccagtcgttgtaaaatcgccaggacgtaaactggcgatgattggatgaccagcatctaattgcttaaacatttcatttttgctcaatggcacagcagaagcgattaagccaaattcattacagccgctttccatcaatgcccatcttgtcatactgccttcaagaaaatcgttcttaatagcatatttagcaacatagcgtgggttataagttgttttgccagttaagccaacagcaaccatcgatagacaggtagggccacaaccggcagttccaataatttcatcaccatatgtagtatatgcccagcgcttatcccattggatatataaagggatgccattaggactatctaagataataggatcggtgttttcattgggttgataattttctttcagttcaattgcttgaggatttttatcaacaaattcattaatgtattgggggcagtctaccttatcaagtgcacctgaattatcattgtatagtaggggagggattatttggagacataagtaaccaaatataaatataatgataaaagcgataaaagcaggaattttttttaattttttaagtttcataaatgcattgaatagtatttaattacaattgaaaatatagtaattacccccaaaaccaatacaataaagaatttttcttttttatttaattttttttccataatattgctccttaaatgatgaatgtagtgagaagaaggggagcgtagttataaacagaaattaatccgatactcccgaaactaagtaagaataaactagtcgaaacattattttgacgatgctgattaataaaatgatagattattattccaattaaacagccaagagtatttaggaaaatgtcatcgatatcaaaaactccccatccggtgcctaattgaattagttcaaaagatagactagtaaaaaaaccaataaaggcaatgttgtaattatttagaaaactaaaatagtgtctcaagataatacttaaagggataaatagggaaacattgccaataatatttacaagtagaacttttgttagccctgactggtgatattgattaatgaaatcaaataacactagattactattatagcccatatcaataaaaccattctttaaaatgattattcgtatcagcatccaaaaataatatattgaacaaagagctattgtgatgttgatcaaatagttatttttcttttccatttttatcaccccaatcaaaaaacctattctacaatgattattatatcaagtgacaatagaatatatatttagatactctaaagaaaatcttacaaatttcttacagcgaagtatatagaaaatggtctaaaaagaagctggctatataatataaaaataaaattataaatagagttgaatttaaagtcattttataaaaaaaatcatatagtattttgagggggtgaataaatggttagagaaggtattgatgtttcacaatatcaaggtcaaattgattgggagttagttaaaaatcatattgattttgcaatcttacggtgtggttatggtcaagatattcctggtcaagacgatcctacttttaaaagaaatgctgatgagtgtacacggttaggaattccttttggggtatatttgtattcttatgcaacaactgaaagtgaagcattgtctgaagcacgacatgttatgcgattggttgaaggatataagatggaatacccagtatatttagatttagaagatccaagaattggacaattatcgaatgaacagattgaaagaaatagtcgtgtatgggccgaagaactagtaaacaatagatattttccaggattttatgcatcatattattggtggacggaaaaattaactggacctttatttgatcgctatacaaagtgggtagcacggtatgctgaagaattaggggccgaaggttttgatatgtggcaatatactgataaaggatttgttgaggggattaatgcaccggttgatcgaaattatgcttatagagattttcctgcagaaataatagcaggtggatttaataactttgaaggtgatgaaacaattcctccgattactaattatcaggtaggagatcatgttacattcgatcatgtgtttgtttcttctgacagcacgacaccattgattccatatataaaccacggaacgattcgaagagtcgtaaagggagcgagaaatccatatttgattggaaatggactcggctgggtgaataatgatagtataacgggaatgatgcagtatttatctaatccgacctaccgaggagattcttttgtagatgcattggtccaaatcggggtagatgcttcattcgcatctcgaagagagttagcaagaaaaaatgggatatatgattatactggaagtgcaaaacaaaatttagaacttcttcgtttgttaaaggaaggtagattaagacaataaaggattttcctttattgttttttattagaaagattatataaattaaaagctttaattcctgacttttaggaaattaaagcctatttatattggtagtttaatggtaaatgtaattaaatcatcagttaaatcagcttcaattgtaccaccatggagctcaataatctttttagtaattgcaaggccaagtcctgaaccgcctgttttgctattacgagcttcatctaagcggacaaaaggttgaaaaatacgttctaaattatgttcactaatatgtttgacaaagtttgctacctgaataaaaatgcaatcaacttcttttttggcagtgattattaaatctgaattttctttactataattaatagcattacgaataagattatcaaagactcgttcaaattgattaatatctaattcaagagacagattgtcttcaatcttggtaacacagttgatatttttttcatgatataaaggcataaattcataagagatttgaactaacatcattgaaagattaacagcttttcgttctaaagaaatatcactaagattatatttagcaatagaaaaaaattcttcgattaattcttcaagacgaatagctttatcataggcaattttggtataattgcttttttcctcgattgtgagattaggctgattcattagtaggtctaaatatcctacgatcgaggttagtggtgtctttaaatcatgggccaagtatagtaataaatcattcctttgttgttctgcttgtttaatcgcttttttattttgtaaagattcacgtttaatttgattcatttgatcttcaatttcttttaactcatatggtaaactgatcagataattattatcggcaactaaagtttttcccgcttcaagcattttttcaatatactgtaaagattcacggtagcgaagccaaaaaataataatagtatcaaaagcaatcaaagtaattgaaatagtcactaaattatccttgatgatttgtgctacctggtagacaagatcatattcttgccaaatatactggtgatatacttcataagaataaagtaataaaataacaaaagttacgaccgtgacactaattgtgattccaatttttttaagtagattagcagtaagactttgcttaaaatgagtattattcaatagtataaccaacgccccaaacagtttttacaaatttgggttttcttgcattctcattcattttttcccgcagtctagcaacatgagccattacggtattattgttatctaaatatttttcttgccatactgcttcaaaaagttcttctgatgtaacgacactgccacgttttgaacataaataccaaagaattgaaaattcaattggagtcaaatttaatggctggtcatataatgtacacttatgattatcattattgatcattaaaccattaaaatcgtatatttgttgattaaccgctggttcgttagtgttataacgggtataacgacgtaattgagttttaacacgagctgccaattctagaggattaaagggtttagttaaataatcatcggcgcctaaggtcaaaccgttaattttatccatgtcattatttttagcagtaagcataataactgggaaaaaataatcttcacgaattttttttaatagactaaacccgtctaaatcgggcatcattacatcaagaattgctagatcataatgattttttttcaagctgtctaaagcttcttgaccatgataaaatttaaaaacttgataactttcattttgtaaatataattccactaagtcagcgatagattgttcatcatcaacgactaagatattataaaccatattatcacctcaaaaatcatcttagcttattttgtcttaaaaaacaatttaaacaccaatatttaagaaaatcgtaagaattaggtttttagtttaataatttttattgattagtaagatatagtgataagattttgtttcaactaagagttgaattataagggataactcaaatgcaagattatttttttatttaatattaatgtttataattaaagagaaaggtggtataaatatgatcaatgtaaataaagtaggtgaattcattactttaaaacgtaaagaaaaaggtttaactcaacaacaattggctaataaactatctgtttctttccaggctgtttcaaaatgggaaaatggtggtttgcctaatgttgagatattatcagatttggccgcattactagagattactgttgatgaattattagcaggtgtagaaaaagaactagagggattatcatatagtaaggcaggggtagatattgcatatagtgatgccataaaaagagaaatgaaacaatatttaaaaactagtgatccacgggtcttaaatgggttaggaccgtttgcttctttatatgatatttcattttcagatattaaacatcccgttttagttcttaaatcggaggaaccaggttcaaaacaaaaactagcgatggaatatggatatagtgaatcgatttgtcatgatatgattaatcatttggttaatgatattgttgttatgggagcaaagcccttagcggtattagatacgattgtttgtggtaatgctgaaaaagaaacgattgcctcattggtgaaaggaatttcgcaagcatgtcaaaataatgaatgctcattagtgggtggagaaacatcaattcaacctcaagttgttgaacatggtgtttatgtcttaacatcaagtattgctggaatagttgcaaaggacaaggtaattgatggttccaaaattagtgctggggatgttatacttgcaattgcttcaaatggtcttcatacaaatggctattctttagttagaatgttaatggataaatatcctcaaattaaattagaacgaatcatgaatgaaacatttattgaacaaattatgaaaccacacacaccatattatcaagcattaaaaggattgtttacgaaggtatcgattcacggtatggcacatatcactggtggtggaattgaaggaaatttatgtcgagttattcccgatggtttaacagctaaaattgatttagcaaagattaatattttgccaatttttaaatatataaaacatcgtggtaatattgatgataaggagatgctaaatacatttaactgtggggttggtttcaatgttgttgtaagtcaacaggataaaaggcaagtcatggaacatctttcagagtactatccttgttatgaaattggtgtaattgaaaatggccaagataaagtggaatttgaaaataaattaaactggttataaagaatagcattaatgctgttcttttattttaattattcttgactgtatactaagaatatagtgtttaatataattgaaaaaggagtgatagtatgacaacacatgaagttgaagagatgttgggaatagcaaaacagacacttatttattatgaaaaagagggttttattacacctcagaggaatagtaataattatcataattatttaaaaaagaacttgatattttagaattgattttattgctccggtcgatggaaatatcgattgatgaaataaaattaatcttaaataatcaattttcaattagagatgctttaaaaacaaaaaagagtttattgaaaatacaaaaattcaattagaagatattgaaaaaaataaacaattaaaataaacgtagataggtgaaaatttcttttaataacgaatcacttaaacaatggatcgaccgtgataccttattttttaataatgaagaaattaaatataataatctagttattcctattaatgaaattattgatttcaatatttcaatgtgtagtgttttatatgaaattacattactaagagtgtttttaaattattatattgatatagatgtccgtactgattatgatgtttattcttttcaaatattaaacaatagtcaagttgtaaagatgttcgattatttgcagaaaaagcagataaggctaaatgatcgatatggattgattgaattatatcgaactaaagatccagtagcattaaataaatatttagacattaattttaaaaagtgggcaaaaaaaagatagtcttgataatccccgagataataattttttgagacatcacttaaaaagagggggataaaaaaatagtactagcagctgctagtactatttaaattgtgctaaatatttttcatttaaggtaataacctgtttcattgccgttataccaggtgcaccgatagtattacgcttattaacgcaagtttcaacgttgatagcatcataaatatcatcatcaaaaacctctgaaatggctttaaattcagcaattgttaggtcatcaagatctttattttgatcaattgcatataggactagctgcccaataattccatgagcatctctaaatgggacccctttattgactaaatagtctgctgcatcagtagcattagtaaatccaccagtagcagatttacgcattttatctttattaaatgttgttgattttaacattccgtctaataattgtaagcagcctttagtcgttgtgagtgcatcaaagacaagttctttatcttcctgcatgtctttattgtaagcaagaggaatacctttcatcgtagttaataaactagttaaagctccatatactcgacctgtttttcctctaattaattcagcgatatcagggttctttttttgtggcataattgaagagccagttgaataagtgtcatctaaatcgacgaattggtattcattagtattccaaataataatttcttcactgattcttgacatatgcatcatcattgtagccatagcacttaatagttcaatcaaataatcacgatcacttaccccatcaatactatttaagcaaggtccatcaaaacctaatagttcagcagtatattcgcgatctaatgggtaggtagtacctgctagagccccagaacctaatgggcagatattcattcgtttataaatatcttctaatcggctgctatcacgtttaaacatttcaaaataagctccgagatggtgtgctaatgtaattggttgagctttttgtaaatgtgtgaaaccaggcatgattgtttcaatatgagttttcattatatcattaatcgttattaatagattatgaattaaagtatttaatataacaacttgatcgcgtgtatataaacgcatatcgagtgcaacttggtcattacggcttcttccagtatgtaactttttaccagtgttaccaattcgttcaattaaagtagattcaacgaaactgtgaatatcttcttgactattatcaatcgttaatttaccagtattaaggtcttctaatatttgatttagagcagtttcaatttcagttccttcagcacttgttaaaatcccttgttttgctagcattttgacatgagcaatacttccttggatatcttgggtataaaaagtttgatcaaagctaattgatgcattgaaatcataaactagctgatcggttggtttagtgaatcgtccaccccataaattcatttcatttcctcctgttataataaaagggcattagcccttttattagtctttattatttaatttcattgctcttacttttgttgaaagtccatataaagtaatgaatccttcagcatcatgatgatcatatagatcaccagtagcaaaacttgcaatatcttcatcatataatgaataaggtgaagttgttccttctttaataatattccccttatataatctgaatttagtagtaccactaacaacttcttgagttttatcaacaaaagcacttaaagcttcacgtaaaggtgagaaccatttagcagcataaactaattctgcaaattcaacagaaactagccgtttatattttaatgtttcacgatctaaaactaattcttctaattggcgatgagcttccattaaaatagttcctcctggtgtttcataaactccacgagatttcattccaacaacacggttttctacaatatcaatgattccaattccgtgttttccgccaatttcattcaattcttctaagattgcagtcaatgattttgctttaccatttaatttaacagggaatcctttttcccattcgataactacatgctctggttcttcaggtgccttttcaggcgatgtagataacactaataagtggtcataatttggtgcattttcaggattttccagttctaatccttcgtgagaaatatgccaaatattacgatcacgtgaataacttgaatcagcagagaatggtagattgataccatgagcttgacagtattcaatttcagattcacgagagtccatattccattttggatcacgccatgcagcaatgatctttaaatcaggtgcaagagctttgataccgagttcaaaacgaatttgatcgttacctttaccggtagcaccgtgacaaatagctgttgctccttcttgacgtgcaacatcaactaatattttagcaatcaatggtctagctgttgctgttcctaataaatacttatattcaaatacagcatcagcttgaactgttggcatgatataatctttgacatattcatcaactacatttttaatatataatttagttgccccacatgctttagctcgttcttctaatccgtttaattcttcagcttgaccaacatcaatacaacaacagattacttcataatcataattttcttttaaccaaggaataatagcagtagtgtctagtcccccagagtaagcaagaataactttttctttcatcatttaattcccccttaaaataactttaaattatcattataataaactatagaattcataattgcaatattttctcgtaattatgcaatattttgttgattgttcatatttaagcaatagtggtaaaataagattaactaaagtaatcgggaggataaaatggatggagtgaaaatcgactataaaaaaatattagaaatagtattgattggtatcggatgttattgggctttaaataattttcaaataatactagatatttttaatagtattcttgcagtaataatgccttttttattaggaattatgattgcttttatcttaaatgtattaatgattagaatcgaaaagattttatctagatttattttagataaaaagtatactagttttaaacgtgtgatcagtattattgtttcattgttgattgttattggggtaattggaataattattactttaattattccagaattaacaaatgcgataaaagtaatcgttaaatcttttccagaaacctttgaacagttacaagtgtggatcaatcaaaatggcaatagttttccgcagttagaaacatggatcaatagtgttgatttaaacagtattgcaagtgaattaagtggtttatttaaaattggacttactggaatgctcggttcaactgttgatgtcatttcaatgttctttacaagtattcttaatttagttgtgggaattgtatttgccctctacatattaatgagtaaagaaactttaaaacgccaaagtcataaattgatcgatgcctatattccaaaacgtatttcagtaaaattgttagaagtggggacactcgctcgaacaactttttcaaattttgtgattggtcaaacagttgaagctttcattttgggaactttgtgtgccgttggaatggctgtgttaaatctgccttatgctccaatggtaggctctttagtagggatcacggcttttgttccaattgtaggggcatttatcggtggtggcataggggcatttatgattttgacagttgatccaatgcaagcattgatttttatcattttcttagttgtgttacaacaactggaaggagatttaatttatccacgagtagtaggctcttcagtaggtttaccgtcgatctgggtactttttgcagtaacggttggtggaggattatggggaattacaggaatgttatttagtgttccggttctttcagtagtctatgctcttattaaggggcatgttaataaaagcggtactaaacctaaaataactaataattaaatctaagtaatttttattaatgaaatgaatatcctgttaaagcaggatatttttttaataactatttagaaaatattctaaatagtttaatattatgttacaatctatttagataatattctaaatagttacaatatcacttgcaattaggatataagtaggatattatgataatataaataataaaaataattttatttatgaaatgaggagattaaaatgttaaaaattgaaaatttgacaaaaacttatggtcaaaaaaaagccgtcgataatttatcattagagattgaaaatggtcatatttatggttttattggacataatggagctggtaaaacgactacattaaagtcgattgctggaattatggaatttgatcaagggaatatttatattgataataaatcaattaaagaggagccgttagcatgtaagaaggtaatggcctatattcctgataatcctgatctatatgaatatttaacaggaatcaaatatttgaattttattgctgatgtatatggggtcagtcaggcagaacgaactgacagaatcaaaaaatatggggatatgtttgaactaacagattctttgggggaaccgatcagtgcatattctcatgggatgaagcaaaaattagcagtaatatcagccttgatccatgagcctaaattaataattatggatgagccgtttgtaggcttagatcctaaggcttctcatttattaaagggtttgatgcgggatttgtgcgatcgtggtggagcaatctttttttcaactcatgttcttgaagtagctgagaaactttgtgataaaattgctattattaaagcgggtaaacttgtcgtatccgggaacacccaagatgtcattggggatgattcattagaagaagtgttcctagagttggaggatgacaatgcttaagtcattgattaagattcggtttcaaggaatttttatgagatcgatgaaaggaagtaaaaataaaaatgccggaataggtaaattagcattgatggtattagtgtttgcttatattgccattgtttttggttcaatgtttggctacatgtttaatatggttttagaaccatttacggcaattggttatgaatggttatattttggaatcatggcagtattaattgttttactttgctttattgggagtgtttttacaacccaacaagaaatttatggtgctaaagataatgagatattattatcaatgccgattaaaacaagtgatattttattaagtcgtatttttgtggtattaatcatcaactatttatatgaggcattgattgcaatccctggtggaattgtttattttactcaggtgccgtttgatcttttaaaattactctttttccttattgtcattataacgttgccgttattagccttagctttatcttgtgcatttggctggttaatggcaatgttaatgaaacgaatacggaataaaacagttattactatggtattatcgttaggatttttaggactctatttttatttgattaataaacttccggaatatttggttgcattagtagctaatggtaaatcgattggtgaagcgattcaaaatacgttatttccaatctatcatttagctttagcaatcagtgatgtcaatgtcgtgagtttgttactatatttagtttgtagtgtagggccatttgtaattgtaatgtatcttctttcgaagaattttattagtattgcaactagtaaagcaccatcaaagaaagttaaattgaaggattcagatattaaatttagtagccaaaagggagcgttatttaaacgagagttaaaacattttacatctaatccgatggtcatgatgaatgctgctttgggaattgcatttaccgttgttttagctggtgctgtcttgattaaaggtcctgagcttttagatatgttgggagtaattccaccagaatatcaagctttggtgaatgaatttatagttccattgttatgtttggcagtgattgggactaattcaatgaatattattagtgctgctttgatctcgttggaagggaatcgtctatggatcattaaatcactaccaattaaaactaaagatattcttgaaagtaaattgatgctacacttagctttatgtgtaccaccaggattgttattttcaattgtcggaagtgtagttttttcattgagtttagtagatagtttattagttattatcgtccctatagtttttacggtttttgaagctttattaggtttattgattaatttatggaagccgaaatttgattggatcaatgagactgttgtcgtaaaacaaagtgctgctgtaatgattacaatgtttggaacgatggcgcttgtagtttttataggtggtatttatattggttatttaaatgagtttattggtgctgtaacttatgtttatataatgctagcgcttttcttgattatcgatattgctttctactatttgttaaatacttggggaattaaaagatttgaagaattataggcatgtgtttacgacacatgcttttaaattgttggaaattcaaataaatatttgacaaatttttttttagtaatataataataaccaaactcggtgactaaaagagtagtcttaataatggttttagcgagctggcgttggtggaaggctggtaatctagttaggatgaagcgcatttatgagaggaaagtgggaaatagtagtatcgctttcgggtaatcacccttaacgatgaaagagatcatagggtcaacttatgataaatagagtggtaacgcggttaaatcgtctcttgtttaagaggcgattttttattttaacaaagaaatggaggactagaaatgattagagtaggaattgtgggatcaactggatatgggggatgtgagttagtccgatttttattaactcacaaagaagtggaaattaagtgggtttcatcaagaacctacactgatgaggagtatagttcggtttattccagctattttaaattattggatcagcagtgtgttgatgaggatattacaaaatatcttgatgatgttgatgtggttttctttgcgactccacaaggggtttgtgccaaaatgcttaatgaggaagttttaagcaaagtaaaagtgattgatttaagtgcagactatcgaattaaagatgttaagacatatgaacaatggtatggaattgatcatgcttcaccacaatttatcgatgaagctgtatatgggctgtgtgagataaatcgtgataaagtgaaacaggcacgattaatagctaatccaggatgttatccaacttgttcaattttatcagtctatccgttagctaaggcggatttaattgatatggatactttgatcattgatgctaaaagtggtgttagtggggctggccgtggggctaaagtcgcaaacttatattgcgaggtaaatgaaagtatcaagtcttatggggttgcaagtcatcgtcatactccggaaattgaagaacagttaggttatgcggcaaatcaagaagtattattaaacttcacgcctcatttaattccaatgaatcgaggaatcttaattacagcttatgcaaaacttaaaaagggagttaatgaagtggatgtcgcaaaggcttatcaatgttatgatgatgagtattttgtaagggtattgaaatctggggtcttaccagaagtacgtagtgttaaggctagtaattttgttgatattaattataaagttgatccacggacaaatcgagttattatgatgggagctatggataacttagttaaaggagcagctggccaagcaattcaaaatatgaatattatgtttggattagatgaaaaagaggggctaatgcttgctccagcaatcttataagggggaaaataaaatgaaaataattgagaatggaacggtaacctcgcctaaaggatatttaggtgctggagaacatgttggtattaaaaaagcaaaaaaagatttagcattgatctatagtaaagttgatgccaaagcggtaggaacttttacccaaaatattgttaaggcagcaccagtgttatgggataagatgatcgttgataattatgatcatgttagaatcattgctgttaatagtggggtcgcaaatgcttgtactggcgatgagggtttaaaatgtaacgaagagtttgctcaaactgtagcagataattttggattggaaaaagaggaagttctaatttgttctacaggtgtaattggtaagcaattaccaatgaataaaatcattaatggggtaccaattgttaaaccgttattaagtgagagccaagaagcaggggtaatcgtagctgaatcaattatgacgacagatacgaaaccaaagcatcttgctgttgaaattgaagtcggtggaaagacggttactttgggagcttgctgtaaggggtcaggaatgattcatccaaatatggcaaccatgctgggatttattacaaccgattgtaatatttctaaggaattattaaataaggcattgaaagaagtaattcctgatactttcaatatggtttctgttgatcgtgatacttcaactaatgatacagtcttgttattagctaatggattagctggaaatcaagaaattgttatagaagatcaggattatcaaatatttaaagaagccttatattatgttaatgaatatctagctaaagcaattgccggtgatggcgaaggtgcaactaaattgttagaagttcaagttcataatgctgatacagttcaacaggctaaagtaatcgctaaaagcgtttgtacttcaccgttagtaaagacagcagtatatggcaatgacgctaactggggaagattattatgtgcaatgggttattctggtgaacaatttgatccatataatgttgatttgagcgttgctagtgaatttggggaattgcaattggtggctaaaggaatggcgactgattatagtgaagaattagcaactaagatcttatcaagcagcgaagtaaaagcaattattgatattcataatggtgattgtaaagcgattgcatggggatgtgatctaacttacgattacgttaaaatcaacgctgactatcgttcataataaaaatttaattaagggggaaataatgtgcatacagttgagcaaaataaagcacaagtattagtagatgctttaagttatattcaaaaattccatggagatatcgtagttattaaatatggtggtagtgccatgactaatgaagttattaaacacagtgttttaaaagatattgcggttctaaaatcagttgggattaaaccggtaattgttcatggtgggggaaatgatatcaatggatggttaaagaaagttgatattaaaagtgaatttaaaaatggcttacgggtaactgataaagaaactttagaagttgctgagatggttttgtcagggaagatcaataaaggattagttcaacatatggaaagaataggaacccatgcagttggcttatctggtaaagatggtaatatgattacagtaaaaaaagcaatgccaaaaggggatgacattggttatgttggggaaattataaatgttgatgttactttactagaaacattgttagaaaaggattatacaccgattatttcaacagtaggattagattctaagtataatgcttttaatattaatgcagatgatgtagcaacgggtgtagctcgtgctttaaaagcgagtaagttagtatttttaactgatattgagggagttttacgtaatccgagcgatcctagtacacgcatatcagtaattaatacagagtcagcagctgaattatttgaacaaggaattataaccgggggaatgattccaaaattaaaaaattgtcttgaagcagttcaggaggacgtaaagaaagtccatattttagatggccgtctggaacatagtttattaattgaaatttttacaactagcggggttgggacagaaataaaaaaataaaggtttagagcctttatttttttaatgtcacaatattgatttgattaggacagaaaagacgatattcgtatccgtcttccatacctaaaccgttagaaatcaataattgactttttgatttagtgtgttcaccactaacataagtattaccgttagtttttttaaatagtccgccaataaaaggaagacgaatataaccacccattgtatgaccggaaagttgtaaagcaatttcattatttgaagtcgtgttaaaataatctggttcatgaactgcaactattttgtaactttcactattattttcattaattagaccacttaattctcctgttccctcaagaccaaaaagactaatcgtagatccattaaaataaataggacgatattcgttatgcagaacttcaaaaccaccctcatttaaaatggcattgacatcatttgatgaagctaaatctttttcaccaagaacagcaaatttaccatatttagattttatattgaataataattcgattaccttatcgttatcaaagggcgtggctgaaaagaggtcaccaccaaaaataaccatatcaacattttctttgtttaatgaagtgacaattttttttaatctagtaacatcactacttttttggagattaatatcgctgataaaaccaatttcaaaattcttgaattcatcaggtaaactattattagtaatagtcgttttttttatagaataactatcaggagcgatatatcggctataataataaccaaaaccgctcccgataataacgattatcaataatagtagtttaatcgttcttattttttttctcatgattttttattcatgataaccggaataatcattggattccgtttagttttgcgataaaaatatgaagataatgtatcgcgggtagtattcttaatttctccgaaagtagttttaccttgtaacaattttgataaatttgtttcaactaacttctcagcttcacgaatcatgtgaaaactgtctttcatatatacgaaaccacgtgagataattactggtcttgtcaataattttccactacgagaatccatactaattaaaattgaaaccattccatcttcagataacatttgtcgatcgcgaagtacagctgtggataagccgctaatatcattaccatcaacataaatatcttcaacatgaattctcggacctaatcgagcctcaccattattcaataaaattgtatctccatttgataaaacaaatgaattttctggtggaataccgacatcttgagataattcagcatgaatcttcaacatgcgatattctccatggacagggaagaagtatttaggtcttgtcaataacatcatcagtttttgttcctcttgagaagcgtgtccggaagtatgtaaattattgaaagcggtatttgttagtaccttagcaccagctctaaataatttatttactactacattaacactataagcgttacctggaattggatttgatgaaaagacaacagtatcgccgggtttgattttgacatatttatgagttccatttgcaattcgacttaatgctgctaatgcttcaccttgagaaccggtacataaaatcaaaatttcattatctggtaatttttttgcttgttcacttttaataaagaacttatcaggacatttaatatagcccatagctcttgaaacttgaatgttgttttccattgaacgaccgtatactaaaattttacgattaaatttaacagctgcttcgacaatttgttgtactcgatgaacgttggaagcgaaagttgctacaatcaaacgtccctctgtttttctaaattcctcttgaacactattagcgaccttcttttcactgattgaaaaagtaggaacttcagaattagtagaatcactcattaataaagtaaccccagtttcacctaggaaagacatcttttgataatctgctggatcaccgactggtgataaatcaaatttaaaatctcctgtttcaacaatccgtccattaggactattaataataattcccattgattctggaatagaatggtttgttttaaagaatccaatattaaaatatttagatttgatttgatactcatcgtcgatttgaataatttttgtagcattagttagtcttttttcatctaactttcttttaatcatggcactagcaagtggtgtagcataaatgaaaggaattttaactacttgaagtaagaaaggaattccacctatatgatcttcatgaccatgggtaatcattaaaccacgaattttcttttcatttctttttaaatacgagtaatcaggaataacgtaatcaattcccggtaatccttcttcagcaaattttactccggcatcaataatgaataattcattatcgtgttcaacacagtacatatttttaccgacttcatttagtccgccaagggcaaataccttagtatcaatactattttttgtttgttttgatttatttaccgctttttttggcgtgttgtttcgagatttacttttattattatgatttttttgtggtgacttgccaggtcgtttattatttgtattaggcttttcttgcataataacctccttaattatattttgtatctttttaagtattataacacatattaaaagacaagaaacgaagtttcttgcctagataatctttttgcatgcagcaatggctagagcatgcggtccaatatgacatgaaacactaagtgacaatgggtcacaaataattgttgaatcaggataaatagcttctaattctttctttaattctaatgctggctgttcgtcgtatgtatatgcaatacaaacatgaacattctttccttttccttctggatcaagacgttcatcaatatctttttttattgcttccatcataattttagttgctttagacattgttctggtcttagagaaagtatcgagcttttcaccttgaatttgtaagattggtttgattttcatcattccgcctaaaattgcaacagcaggagtgattcttccacctttacgaagataatctaacgtattaacagtaatatagatagaagcatttaatttatttgcttcaagaatttctttgatttcttttgctgatttaccagctttagataattcaagtgcatccagaacatcccatttttgagttactgaaacgcgttgtgaatcaacgacttgaactcgtccatcatattcacctgctaacatcaaagcagtttggcaagagccgcttaagccactagacatgggaatatgaacaatttcatcatactcttttaatacttcatcccaaagtttactaacatcaccaactacgggttgacttgtaaaaacttcagcatctgtcattagttttttataaaactcatcttgagataagttgatatcttcatagaaggtctgaccatcaatagtaaatggcatcggtagtacgttgattcctaattttgtaccttcagcctgagtgattccagaattactatcagtgataattgctactttattcatttaaaaacctcctatctctaaaccatattttacttgaaataataaaaaatgcaaactatttaaccattattataaaaataattaaatgaaaggcattacaatatataactgtattatatattgtaatacagttatatatttggtatactacatttgtaagaatgtagtaggaaaggagttattatgcaaatagataataatagcagtgttccaatttatgaacaaatctataaacagctgctcgaatatataacgacagggttaatgcatgcggacgataaactaccctctgtccgtgaattatcttcatcaattcatattaatcctaataccgttgttaaagcctatcgtcttttagaagagcaaggttttatttattccttgccggggaagggaagttttgttagctcaaaacaaaataatcaaacgaagttgtttgaacaacaaattaaagttctcacaaaagagattgttactaaaagtaaatatattggtttgacctttgaacaattatgccaatttatggaacagacttgggagggaaaataatgttattagtcaaagaattatcaaagaaaattgatcacaaacaaattttggacaatattactttaaatatacctaaaggttcaatttatggaattattggtgaaaatggtgcaggtaaaacaactttgattcgtcatttagtaggtgcttatcaaggtgatacaggatttgttgaattagaaggaatgcgtatttatgaaaatcctgaagcaaaagcaaaattagtatatatccccgatgaattttttgataccttcggacataatattcgggatattaaagaattatatcaagggatttatccaagttttaacgaggcacggtatttaagattgatgaaaatgtttaagcacgatagtttagaaaattttagtaaattttctaaaggaatgaaaaagcaagttatgtttattttggctttagcgatcatgcctgaatatttgatcatggatgagccgtttgatggacttgatccacatattcggaaagttatttgggatattttgattcaagatgtaagtgagcgaaatatgacaatttttatttctagtcatcatttaaatgaattggatagtatgtgtgatcatatcgctttgatcaacaatgggaaaattgtttttgaagaagcactagatcatcttaaagaaggctatcataaattacaaatcgtcttagagtgtggtgatgatatgtatgctttagagaaagaattaaaagttttatctcatcaaatgatgggacgtgttcatactttgatcgttgctggtgaaattgaagtaatcaatcgtactgtggaaaagtattgtcctttaattaatgaaactttatcattatcattagaagagattttcttatttactttaggaggagaatatgatgaactcaaggaagtcatgggttaatattcccttactaaaaaatatcattaaaaataatctctttcctgctaaagtatcattaattatttttgtgggagtctttattttatcgcttatttctggttctaatagtggttttagtcaaatttgtatagttgtatatggaataagtgcagttgttctaacaacgatatacccttgttttattcagagttatcaagttaataaaacgaaatcatcaatgatgtgttcattaccgttgacgacaagatgcgtttggtttacaaattatttagctggatatttaattgcgctagttacattattgattgagggattaggtttgatgatgtttttaggattaaataatgcggggactgaaggaaatatatttataagatttataatggcgatatttcttttgttatttatttattatacccttacttatttagtttgttcactgtctggtaatcgtttgggacaagttgtgtttagtttagcagcatatgcattaccagtaattttattattggggcttatttatattagtcctaaattagttccaagtaatcttgatcttggaattaatgacacatatctttatcttacttttccgttagctgctggaatgcagtttatttatagtgcgtatccacatatatttttccatttatttttaggaattgttaccttaatctgcagctattatgtttataaaaatcgtgaaaatgaatatattggagaacctttagtatttcgccgaattattattgttttaaaagctattttgattattgctgtaacgatatgtggttttgaagtcattttattagtatcaaaaattaatatcacatatggattcaaaggtcagtcacttttatttttaatctatattttgattgggatgattgtagcgataatcgttgaaattatttttaaaggaagacatgtttatcgtaatttattaatctatgtacctgttttagcaattgtttttggtgctaattttatgattgtcaataagcaatatctttcaggaattaataattcgagatatgaagttactgctgatttagtagctgaattagctggtaatcaggagtatcttagcttaagcttaaataatgaggttacaaaggaattcttgaattatttgagtaaacatcgtgatgatcttcattttgaaaaatatgatgatgaacaacaagatttagcaatgatgtatacttatcaatatgaacatggattagatgatgattattatagctatagtatctattatattaataaaaaagcagtaattgatttctttaatggaccaggaaataagtattttgataagctgcttaattatactgagggtttaaaaaaggaaaaaagtttaatttgttatgttaatgattatgcagtctatttaaataaagaggaaattcaagaattgattaaattgttgccaaatcaagaaatcaaacctaaaaatatatttagtattaaaacatataatttattaaatcctgatagtgtcaattatttaataagcagtaatgaagcaataacgaattttattactagcgatgagttgatcgaacgagctgtttttattgaaaattgtcgagatgttattgatgatattaatagtgattcaacaaagtttgaagaacaaatcaaagccgtagtgagtacacaatttagtcacgaaacaattgatatggtctatccaaacggtgatagcacagttatagcctttagtaatgatgaagttatttatcaaggtacctatgaagttgttacaaaagaaggaaataactatacttatccattagaatttaccttaaagaaaggtgatgatggcgtgatcgttaatgatataaaggtaggtggttaaagatgatgatcagtttattaaaaaatgatttaaaacagctaaaaaatacagttgttatttttagtggttttctagctttaagtttggtaatcagtctgatttcttttcactctgatgttcctgtaggaatgttttatctaattatcttactctattcattagttgttccgatggttaatttaagttacttatttgatcaaacccaacagactcatttttcatctttgccatatacaaaaatacaaagttttatgatcagatatttaagcggattattgtgcataattatacctgtcataatctattgtattgttgatgttattttaggacaaggattagtacttaaaaattgttcttcagcaattttaatgatttggatttattatagtttaggtaatctagctgcctatttaacgacatcagtaattatggatattattctacaaattgttattaatatatcgccattcattatttatatgagtttattttctgtttatcagacttttgttagaggaatcattagtgctgatttttcaatggaggtcgtaagtattattttgcccgcttttcgattatttattggtggacttagtggtttaagttcttattatcttttgctgtatgctggttatggtctagttatatttataatggcttttttagcaagcagtaatcgggagtgtgttaacaattatcatggtttcacttataaaatcattggtgaagtaattaaactaatttgtattatttcagtttcttggctgattacttctattttggatattcctgttcaatctttgaagagttttattattatcaatattattgcaacctttgttgcgacttttattattcaatttattcagtcaaaacgtattaggtatgtattgtgcatagtgcagggaacattaattgttttagttacaattgtaatttttattggttcaaaaggatatttagaaaattatattcctcatgatattaaagcagtagaaattaattcaaattttgggtacaacaagattaatagtaaattaactgatcaaaaatcaattgatacagtagtggcaattcatcaggaaattttaaaacaaaaaagtgattatggcagtcataacttaaaaattacttattataaggataatggtgataaggtaacaagaggttatcaaatttcggatcaagaatatttaatggtaatcaaaaagttagatgcggcacttttaaaaagttggtttgataattattattatattattaataagcttgacacatatcaatatcttacttatgcattgccgggtgaaagtgagaatgaaattagaacagaaaatgatattctattatttaaaaatattcttcaaagaaagctgtcggagtttgaaaataaccctaatttattagtaaaagttgactatgataatccgggtcaaattactagatttaagcgttctaatgatggtagtgaaagttatcaaggtgattcgatttcttttgacgataatgacccaatgtcgcttgctttacaagaatatgataaaattaaagcaaattagttgtaattatttatagattaggcataatgttaatgaggtgataaaaatgaaaattttaaatagtaatgaatttgataacgcaattgctagcggtatcgttttagtagatttttatgctgactggtgtggaccatgtaaaatgttatctccagttattgaagggttagcagaaaagatggagcatgttaatttttataaattaaatgttgatgcttctagtgatattgccgggcgttatggggttcaggcaattccaaatttaattatttttaaagatggtaaagcagttgaccagattactggttttgttcctgaaaatgaaattgtaaaacatttacagaatttattataatgtatttaagccatggtagtgttaccatggtttttatattttgaaagtttttgaaaaattcagctaaataagtctaaatatgataaaatctatacatatagaaatgtaggtgaatttagatgaaagtatctttttatgaatctgtagcggagcatgatttaaaatttgcggtaattattagccgttatttaaaacagtgggtattttgtaaacataaacagcgaaagacatttgaaatacctggaggacatcgtgaaaatggggaaagcattgaagcatgtgcaagacgtgaattgtatgaagaaacgggagctgttacttatacgcttgaacgtttttgcgactacggagttgttgagaaaactggatcaaaagagtcttttggaacaatattttatgccgaaattgaaaaaatggcggatttacctgattctgagatagaaaaaatatttttatcgaaggaactgcccgaatgctggacatatccggaaattcagccttacatgatcgatgaatataaaagacggagaggatcataaatgaaaaaaatatttatagtaatgatgatagcaggaattttaactggatgtagtgattcatctactaagagtataacagtttgtaaaggaagttttgattatggcgatattgaaaatacttatgaagctaaaggcgataaggttatcaggatcgtgaatgtgacgattaatgattatagagatacggattatgatgatgagaccttagttagtacacttgaatcacaattaaatgtatataaagaaatagatgggttggaaataaagcttactgataaagatcaaattgttcgtcaggaatttataattgatatagaaaatggtgatttaaaaaaacttaatgaggttggattaatagatttaaatggtgatggaacggtttcttttgaaaaattaacaaaaaatgctaaagagaataaattaacttgtaaagaaaaataagcaggagatatgatataataagtaaaaggaggtgtgattatggcacgaaaacctctgaaattaacgaaaaatgcgttaatgttattggggataatagcgttactattgataacttttttagttttaaagtttggtgggacaaaaagtgaacaaccagaaaaaaaagtaactgaaacattaagtggattagttgttgaaaatcaggtcttaaaagttcagttattagattttgtaagtaataaggattttgatgataagtatcaagaagtttcaatggatattaaagcagatgaagaagtattaaactataaaatatcaaatcgtcaagtttttaataaagtgatgcagttattaccgccaggtgagggctctcctttattgaataacagcagtgaggtacctactcatgaagcgtatattcttgttttaactggtgatattgttgagtataaagatagtgaaggaaagagttcttatcaaattgctaatgcacgtcttgattactataaacaatcattgttgttagagaatgattatgatagtgtgtatatcgcttcaattgatggaaaaaaagaaaaaatggtcaagattactgcatataaggaagcactatccagtccaagtgagtatatgacaatgttacaatggtaaataaaaaccttagcaaaataaaatgctaaggttttttagtattattcaatgtttagtccagcaacaaaggttagatcaataccaaacataatgccggtattgggtttatcgatgccgcctaaagttttatcaataacggtccttgctttttcaacatcttcattttttaaaataaagaaaagtgttttgcttgtttcacggggatcttcaagaaaaattcgtaatgattcgataataaaattatcattactttttaatgtattaagcatccctttgctttcaatgatcgtccctccgttaataccacttttttgtaatgcggctaagagatcatctaatttttccactttgtgtaaaactaagaaaagtgcttgcatggaattcctcctttatgtacatcctattatatattataaaccatattattgctctttgcattagtaaatgtttggtttataataaatagtatacaaataagggggtatatttaaatgaattttgaattttcaaatcggatcagtggtgttaaggcatcagcaattagggaaattttaaaaatgatgaatgatccagagattattagttttggtggtggaaatccggctagtgagacttttcctgttgaacaattaaaaagaattagtgatgatatttttaatacttgtcctaattctattttagagtatggaattactgaaggtgacggaagctttaaaaaagcagcaatagaatttttatcacggcatgaaacagtagtgaaagactatgatggtgttatggttacttctggttcacaacaaatcatggattttttatctaaatgtttatgtaatgaaggggatctagttgtttgtgaaaatccaagctttttaggggctttaaatgcatttaaaagtaatggtgccaaattagttggaattgatatggaagatgatggaatcaatcttgaacagttagaagcagttttaagtggggtgcaaaaaccaaaatttatttatttgattcctaatttccaaaatcctactggaataacaacttctttagaaaaacgtcaagctatttatacattagcaaaaaaatatcaagtgctgattcttgaagataatccatatggtgatttaagatttagaaatgatgcaattccttcaattaagtcattagatgatgaaggattagtagtttatgcagctagtttttcaaaaattattgcaccgggaatgcgtgtagctgttatgattggtcatcaagatctattagctaaatgcacagttgctaaacagacaaatgatgttcatacaaatgcttgggcgcaaagtgtaatggctcgtttcttaaatgaaacggatatggaggtacacttaaaaaaattacaggcagtatatgagcaaaaatgtaatttgatgttggaagaaatgaaaaaacaattcagtccagattgtaaatggacaattcctgatgggggaatgtttatttgggtgactctaccagaacgaattgatatgccggagtttgttaaaagagctgttgaacataaagtagcagtagttccaggaaatgctttctatgatgatgataataaaccatgtcaatcgtttcggatgaatttttcaactccaactaatgaacagattattaaaggggtcgctattttaggagcgttaatgcatgattaaaaatattgtttttgatatgggaaatgttattttgcgttgggatccgcactatattgctagtaaattatcaaatgatagtttagaacaagatgtgattgaaagagagttatttgcttcaaaacagtggcaaaagctagatcaaggattactcaccgtggaagaagctcttaaggaattaaaaaccgacaatccgcagttgattagacatgcattattgcattggtatgattattttgagccttttgctgaaatggtagcattagttaaagaactaaaagagcaaggttatcatatttatctattatctaattgcagtctccaatttgatgattattaccaaaatatcgaagcttttaaatattttgatgatttttatatttctgcacgctaccaattattaaaacctgatcttgaaatcttcaaacattttctttcaaaatttaatttaaaggctgaggaatgtatttttattgacgatataaaagctaatgttgaaggtgcaaagattgctaaaatgcatggttatcagcataatggagatatcaaaaagttacgattatatctaaaaaaacaacatgatttaccaataaattattaataattcttaaaaataccatacttttcaactgttttggttgacaattaaggggaaaatgctagaatgctaatagacaaaataatcgcttatattgggagaatttagatggataaacaagaggaaaatatgagtaacacaaacgatacgattgaatcaaagcaaaagtcagaaatgactaaaaaagtaagatcagggaaaaaaacaggggtacaaaaaaagattattattattggaatcttagtatcattattagtcattatttatttaattggaagtttttatttcaataagaagtttttaagtggtacatacattaatgatatcaatgtcagtggtttaacattaactgaagcgaatgaaaagttagcggaacaaatagatgctcgttctttaaaattgatttttaatgatgaagcaactgaaacagtttcaggaagcgaatgtggagttcgctataatagtaataataatgttaagaatattttgaaaaagcaaaattcttttgggtggattggagcttattttaataaatcgaaaaatgtagttaatgatctagctgaagttgatgaaacagttttaagagctaaggtggcttctttgggacatcttcaagaagaggtgcaagtggcaccggtcgatgctaaagtggaatatctaaataatgagtttaccatcaccaacgaggtcaatggttcaacgattgatcaagaaaaactaattagtgaaataaagttagcctttagtgaaggtaaagaaagtttaaatttaacggagaaaaaatgttatgtagaacccgctgtaaaagctaatgatgcgaaattacaaaatttattagatgcagctagaaagtatgcatctgcggcgataacctataaaacacgttctggagatgtagtgttagatggtagtactttggttacttggttatcaatagatgaaagtggtaattattatcgtgatgatgctgtatttaaagaaaaagtaactgactttgttggaagtttagcgaagaaaattaacagtgttggtggaagccgaacttttgttggggctaataatcggacgattacagttagcggtggtaattatggtttaagactccaaaatagtaaggaaataagcggtttattagaagatatttatgccaataaagtgggtgtcagaacacctgttacaactggtcgtgaagcttctttggataatggtggattaggtgatacttttgttgaaattgatttatcagggcaacatatgtggtatcataaaaatggtcagatcgtattagagtcagatattgtttctggtacatacaatattgctgatcgccgtacaccagcgggtgcctattatttatataataaggaaagaaatcgtgttcttcggggaacaaaattacctgatggaacatggccatatgaaactccagtttcttattggatgccttttaataaaggaatcgggttacatgattcttcaagctggcgttctaagtggggtggaactatttatatgaacaatggttctcatggttgtattaatttacctacgggaattgcttcacaattatataatagtattgaagttaattgtcctgtagtttgttattattaataatgtaaaacagtcttaaaattgctgcgatctcaaagaaagtttaaaagagtagccctaatccttttaaattattcaaaacgtatcagtaaataaggctgtttttattgtttaaattattagtaattagttatatacttgaagaagagaataaaggagttaaatgatggaaaattatgtaatagattttgcaactaaaatattaaatattgatagtcctacaggttattgcaaagaagttattgaatttgttaaaaatgaagttgaacaattaggttatcgtacaggaatgaataataaaggaaatctttatatttatgttgatggcaagaatgataaaacaattggtttatgtgctcatgtggatactctaggcttaatggttagaagtattagagataatggagaattagctttcactaatgttgggggtccaatcgtcccgactctagatggtgaatactgtcgagtaattacacgtgaaaacaaaatttatacaggaactattttaagcaattatcctgccgctcatgtatatgaggaatcaaaaacagctattcgtaaatgtgaaaatatgcatattcgattagacgaagttgtaaaaaataaagaagatgttacagctttagggattgataatggtgattatattgctattgatcctaaaacaacatacactaatagtggttttcttaaatcaagatttcttgatgataaattaagcgtagcttgcctagttactgttttaaaagaattgaaagaaaagaatattgttcctgccaacaatgttattatgatcatttcaacttacgaagaagtagggcatggcagtgctagtattcccgaaaatattagtgaattgattgcagtggatatgggatgtattggcgatgatttagcatgtagtgaatatgatgtgagtatatgtgcaaaggactctagtggaccatatgattatgggattacttcaaagtttattgaacttgctaaagctaaaggacttaactatgcagtagatatttatccattctatggtagtgatgttagtgcggccttacgaggtggtaatgatattaagggtggtttgattggaccgggagtacatgcttctcatgggatggaacgctctcatcaacaggctatcaacaatacgattgaattgattttggcttatctacaggcgtagtaatacgccttttcttgtgtcaatatttgaaaatcaagcaatcgagatagaaaaaagttgtactaaaaataatggagggatgaaaatgaaagcattagcaagtgattttgatagaacactatttttttacgatgagagtggttcatattatcggttagaggatgttcaagccatcaaacattttcaaagtctaggtaatttatttggagtttgtactggtcgttcatataaaggaattgaggattttaatcctcatcagatagattacgatttttatattctatgttcaggagcaaaaatattagataaggaaggaaatttaatttatcaaaaatttatagataaaaaaattgctcaaagtatttatgaacaatacgaggctgtcgatactagtattgtttaccaaggagatatgtatgtacttaatcgtacttttgatttatctccacgggttaaactaattacatcatttaatcaagttggggagcagtttgaagctttttctttacattttaaaaataatgacgaagctggtaaagaatacactaaaatgattgatatgtttggtgatgttattgatgtttatcaaaatgagcggcaccttgattttgctgcgaaaggatgctctaaagggaaggggattaaacgaataattgagttctatggcttagcttatgaagatatggcagctattggagattcatggaacgatatcccgatgttaaagagtgttgaaaattcttttacatttaatcgttctcatcaaacagtcaagaatgttgccaaatatttagttgacgggatagatggatgtattgaagaattaattaagtgtcacaaataaatttatttgatataatgtatcagaggtggttaaggtgttaagtaagtatcaaagaatatctcaggatttaatcgataaaatagataaacaagaaatcaaagtacattcatatttgcctagtgaaaatgagttaatgaagctatataatgcatctcgtgatactatccgtaaggctttggatattttattaaaaaatggttatattcaaaaaaataaaggaaaaggatcactagttttagatgttgataaagtcgcatttccagtttctggcgtaatgagttttaaagaactagccaagactattaatagcgaggttgttactaaagttattgaattatctttaaacccagttgatgttcaaatgaaaaaagaactatatatggatagtggtaattattataaaataagacgaattcgttcatttgatggtgagcgggtaatattggataccgattatttaaatgctaatattgttcctaatataacagaaacaattgctgctgattcactatataattatattgaaaatgaattgggtttaaaaatcagttttgcaagaaaagagtttacagttgttaaggcgacagaagaggaaaagaatttattagatatgcatgaatatgatctattagtatgtgtgaaatcttatacatatttagaagatgcttcattgtttcaatatacgatttcgaaacatcgtcctgataagtttagatttgttgattttgcaagaaggactcaactttaatgagttcttttttaggaggggctatgacacaaaaagattatttattattccaagacaatattagaaaagaaaaagcgaatttagatagtagatcattaaaaatttcaattgctcgtttaattattggattattgattgttggatttttattaggaggcaattttactaataatcagttattagtatattcatcattaatttggattgctatttttattattttaatagttattcatagtaaaataacggaacgattgagttatttaaatgctcaagcaattgtaattcaacgttatttagatcgctataataatgattggaaagcttttgatgaaacgggactagactatgttgataatgttactggggtgatgaaggatttagatttagtgggaaagaattcattgttccaatattttaatgttgcaagtacgattcgtggtaagaaatgtttgcttgataaattaacgcgtacaagttttaatgaaaaaggtattattgaagagcaaaaagctgttttagaattatcgaataataataattttgttttatcattggaaacctatggcagaatgcttgaaaaacctaaagttaatgaacgaattattgaggattttgttaataatttaggaaaaaataaagttaaacggagctgggggtttgctaaatatttaattccgatacttacgattattaccattgtcatgtttcttttcgaattttatttcaagttatcagtaattttagtgccagtgctaatttttggacaactgattattgcaattataaatctaaacagtcatggaataatttttgagcaagtttctaaattatcacattgcttgaataattatcaaaatattagtcatctgattaaacaatccacttttacatcaccttttttggtagagttacaagcaagattagaggcttcaagtatagcttttgatgaactaaaaagtcttagtagtgctgttaagcaacggaataatcttttggcattcattttattaaatggacttttgttatgggatatcaattgtaaagaacgatatgatcgttgggttaagcaatatgctagttcaattgagcggtggttagatgcaattggcgaatttgaagctttaacgagtttacaagtattactccatactaaagatgttacttgttttgcgaattttcatggtgatcaaactacatatttagaatttggtgaagcttatcatccattgatgccaaatgaacaagctgttgctaatagttttatgatgaatcaccaagtatgtgtaattacaggctcaaatatgtctggaaaaacgacttttttaaggacgattgggattaaccttgtactagcgtatgcaggcggaccagttatggcaaaatcatttgattgctcattgatgcaaatttttacttcgatgagaatagaagatgatcttaatgggatttcatcattttatgctgaattattaagaataaaacaaatcgttgaagctaatcgtcaaggtaatttgatgattgagttaattgatgaaatttttaaaggtactaattcaaaagatcgaatcattggagcacaagaaacggtcaagcaattgtcaacaaataatattttcacatttattacaactcatgattttgaattatgtgaattagaaaatgagatttcatgcagtaattatcattttaatgaatattatcaaggagataagattaaattcgattatttaattaaatatggtcgaagtcaaacaacaaatgcacaatatttattgaagatggttggaattacaaaggaagtttagcttccttttttattttattaaaaatgtattgacttacatgtacgtacaagttattatataattacaaaagatgtacgtacatgtaaaaaaggagaaaaaagatgggaaaattcagtagtgatgcaagtaaacttttagaatttgttggcggtagagaaaatattagagcagttagtcattgtgttactagaatgcgttttgttttaggggatgagagtaaagctgatgtagacaagattgaaaccttggggagtgctaaaggtacatttacacaaggcggtcaatttcaagtgattattggtaatgatgttcaagaattttataatgagtttattaagattgctggaattgaaggggttagtaaagagcaagtaaaaagtgatgctaaatcaaatcaaacctggcttcaaagattaatgggaaatttaggggaaatctttgctccattaattcctgcattgatctgtggagggttgattctaggatttagaaatgtgattgattcaattgcaatgtttgaaaatggaacaaaaacattagttcaaatttcacaattttggagtggtgtagactcatttttatggttaattggtgaagcagtattccattttttacctgttggtatttgctggtcaataactaaaaagatgggaactagtcaaattctaggtattattttaggaattacattagtttctccacaattattaaatgcttattcagtagcttcaacagcagctaaggatataccagtctgggattttggattcgcccaagtacagatgattgggtatcaagcacaagttattcctgcaatgatggcgggatttactctagtttatttggagaagttctttagaaaagtttcgcctgaagcaattagtatgattattgtaccattcttttcgttagtgcctgcggtaatagttgcgcatactgtagtgggaccaattggatgggtaatcggtaactttatttctgatgtggtttatggtggtcttacatctaactttggctggttatttgcaacattatttggttttgtatatgcaccattggtaattactggattgcatcatatgactaatgcaattgatatgcaactagtaagtatgtttaaaggaacgatcttatggccaatgattgcattatctaatattgctcaaggatcagctgttttagcgatgatagttttgcaaaagaaaaatgaaaaagctcaacaagttagtatcccggcatgtatttcttgttatttaggggttactgagcctgccttgtttggagtcaatttaaaatatatgtttccttttgtgtgtgggatgattggttctgcaattgccgcaacgttttcggtagcaacagggacaatggcaacttcagttggagttggtggaattcctggaatcttatcaattattccaaaatatatgggaaactttgctattgcgatggttattgcaattgtgattccatttgttttaacatatattgttggtaaaaagaaattaacagataaagacttaggaattgaaacagatataattgataatgagaaatttgtatcaccaatgactggaaaactaattaagattgaggatgtagaagatcaagtttttgcaaccaaagcaatgggtgatggatttgcaattgaattaacagatagtgatgttctagctccagttagcggagaaatcgtaatgacatttcctactaaacatgcttatggcctaagaggtaataatggtgtagaaatcttgattcatcttggaatggatacagtacagttagaaggtaaaggatttgaatcatttgttaaagttggtgaatatataaaacaaggagataaattagctaaagtcgatattgcttatattaaagaacatgggaagtcaatagtctcaccggttatttttacaagtggagaaaagattagtatattaaaagaaaattgtaacatcaaaaaattagaaacagaaattattaaaattgattaaaggaacgaggaaaaatatgtattacgaagataaagtcatctatcaaatttatccaaaatcatttaaagatactaatggtgatggaatcggagatattaagggaattactgaaaaattagattacctgcaaaaacttggaattgatatgatttggatgtgtccgatttttgcttcaccacaacgggatagtggttatgacatcaaagattattatagtattgatccaatttttggaaccatggaagatcttgaattattaattgcagaagctaaaaaaagaaatatttatttaatgtttgatatggtatttaaccacacttcaacagaacatatttggtttcaagaagctttaaaaggaaactcgaaatataaaaactattatttttttaaaaaaggtaaaaatgggaatttgcctactaactgggattctaaatttggtggaaaagcctggaaatatgttcctgaatttgatgaatattatttacatctttatgatgaaaaacaagctgatttaaattgggagaatgaagaagttagaaatgaattgattaaaattgtgaacttttggttaaaaaagggaattcggggattccgtttcgatgtcataaataatattgataaacgagtttttgcagatagtcctgatggattgggaaaacaattttattgcgatcagcctaaagttcataaatatcttcatgaagtcaacacccgttcatttggtcgagtagctggttgtattacggttggagaaatgtcagccactagtgttgaaaattgtattggttatactaatccccaaaataaagaattagatatggtttttagttttcaccatttaaaagttgattatgttaataaagaaaaatggacatcaatgccatttgattttcaagaattgaaagaacttttgaatacgtggcaagtaagaatgcaagaaggacaaggctggaatgccttattttggaattgtcacgatcagccacgaagtgtttctagatttggagatgataaaaaatttcgagttcattctgcaaagatgttggcaacggcaattcatttaatgcgtggtacaccgtatatttatcaaggcgaagaaattggaatgactaatcattactttacaaatattaatcaatatcgggatgttgaaagcattaatgcttaccacattttaaaaaatcaaggtcttgaagaaaaagagattcatcaaattttacaagataaatcacgggataatgcacgtactccaatgcaatgggatgaaaatgtaaatggtggtttttctgatggaacaccatggcttcaagtcaatactaattatcaaacaataaatgtgaatgcggcacttaaagatactgattcgattttttatcactaccaaaagctaattaaattgagaaaggaatataaaataatcagtactggtgaatatattcctattcttgaaaatcatccacaagtatttggttataaacgtagtttaaataatcaagaattaattgttttaaataatttttatggtcaagatgttctcctaaatcttgatgtaatcaattatcaagttttaattaataattataatgaaattgatttaacaaacctttgtttaaaaccttatcaaagtgttgctttgtataaaaaagaagtttagtttcttagtgaaattaaacttctttttgtaactgctgaaattgatattggtaatgtttgtcttagggtaaatctttttatgcgtgataattttttatctttaagaaggatttaatgcaaagtcgtgcaatcatttgttaaataaagtagaatattttagataaaatatatttggaggatagtatgaagataggatttgataataataaatatttaacgatgcaatcatcgcatattaaagaaagaattaatcaatttggtgataaattgtatcttgaatttggtggtaaattgtttgacgactatcatgcttcaagagttttaccagggtttgccccagatagtaagttgcagatgctattacaattaaaagatcaagcagaagtagttattgcaatttctgccagtgatattgaacgtaataaggttcggggcgatttaggtattacttatgataatgatgttttacgtctaattgaaatatatcgagcaaagggactatatgtgggaagtgtagtaatcactcagtatgatggtcaaaaagcagcggatatttttaaaagccgattggaaaaaagaaatattgccgtgtacttacattatttgattgatggttatccaactaatactaaaagaatcattagcgaggaagggtttggaaaaaatgattatattgaaactactaagccgctggtagttgtaacagctccgggcccaggaagtggtaaaatggcaacatgtttatcacaactataccatgaacatattcgcggtattaaagctgggtatgcaaaatttgaaacattcccaatttggaatttagcattaaatcatccagttaacttagcctatgaagctgctactgctgatttaaatgatgtaaatatgatcgatccttttcatcttgaagcatacaataaagtaactgttaattataatcgtgatattgaaatcttcccagtattaaagaatatgtttgaagaaatatatggaactagtccatataactcaccaactgacatgggtgttaatatggtaggtttttgtatgagtgatgacgaagcttgtaaggaagctagtcgccaagaaataattcgtcgttactataatacaatgaatcgctatgttcgtgaagagtgttcattagacgaagttaataagcaagaacttgttatgaatcaggcaaaggttgtagttgaagatcgtaagtgtgttgcggctgcaaaccaaaagtcgaaagaagctaattgttatgcaggagcaatcgaattagatgatggaacaatcattacaggtcgtacatctgatttcatgggatcatgttctgcaattttaatcaatgctattaaatatttagctaatatcagtgatgatgaacatttaatttcaccaacagcctttggtccaattcaaaatttaaagactgaatatttaggaagtgttaatccacgtttacacagtgatgaaatattgattgcattatcattaagtgctgttaataatgacaatgctaagttagcgctacaacaattacctaaactacaggggacccaagcgcacattacttcttctatcggaccaatggatgctaaagtttttagtaaccttggaattcaagtaacgtatgatgctaaaaaattgtaatgtaaaaatatcaaaaatgatatgatgacctcctaacagacagtgtaaataattaaacactgactaggaggtttttatattttgataagacaaaaggatttttagaaatcatactattaataatacttgtatagtttaaaaaatggtttttttagtaaaagaaaatggactgcgcaagcacggaacagtccattaaccagaaaggaggtgttttacaccatacaaatgtatcacctaactttatgataatcattatttgaaaatatttcaacaaatattataatttatgtgtattcatcgaacaaattataatataatggtcatattgcaaccactggttgcgaaattgaaaactagaatatctagagcaaccaagcattattttgcataatgtaggtgatttagggaggaataaatttatgaatatagaaattgcaaatcgattagtaagattgcgaaaggaaaaaaatctttcacaagaggctttagcaaatgaattaggaatcagtcgccaagcagttagtaagtgggaaagagcagaagcatctccagatacagataatttaatcttacttgccaagttatatggaatgtcattggatgatttactaaaaacagatcaaaaagaatttgaaagtggtaataatcaacaagcatcaaaagaaaaaacagaagaagataagaaacaaaagaaaaaagaaagtgttcatattagtttaaaacatgggattcatgtgactggtgaagatggtgaagaggttcatgttggctggaatggaattcatgttgaggatccaaaagaagattcaagaattcatatcgatggttctggtgtgtttgtggatgataaaaaatatgatcaagaagaatggcgtaaaattcgtaaagaaaaaggctgggattactactatgaagattatacaaagtttccttttgcattacttgcaattattgcttatatcgggatagccttatacacggagttatggcatccattatggatatttttattaattgttccaattattgaaggggcaatttctgcagttaaacaccgcaaccttaacagattcccgtatcctgtattagtaattttatattttttgtatgagggattctatgaaaatatttggtcaccaacctggttaatttttttaacgatacctgtttattattcacttgttaattattttagacaacgaaaacaacataaaaataataattgtacagacaatcaagaagattaataatgatatttatcacgggttcatcacaaattatcgaaaaacattaaaatagttgaattatgtgtgattagtctaagatattaattgttattttttaccttcgggtatataatgaaactgtagtaaaaagttatgttaagaaagaaaagaatcggtattgcatgggaccaggaggtaataccggttttactttgttaagaactttttagacattcattgatgataaacggaggagaaaaaatgaaagaattattattaaaaagattgaaaaaatctaaaaataagaaaggttttacgcttattgaaattatcgtagtattagtaattttggggattttagctgctattgctgttccagcggtaatgggatatattgatgaagcaaaggattctaaatatattgcagaagctagatctatatatgtagtagtccaaacagaagaagctaaagctgaaacactaggtaatgcagctgattacactgcgattgctactgaagctgctaagaaaactggaattaacaatgatacagcagacaaaaagatatcaattgagctcaaagaagaagggaaatatacgataaaatggttaagtgacgatgataagtatgttacggcaactgtaacaaagaataaagatatcacaattgatggaaaagaatagagatgttacaattgatgaaaaattaatatcattgtaaaataaactggttatcatgtgatagccagtttttgcttctttagcttatttagagaaaaatttattataaatttaagaaagtattatagatgtatcagaaaaaagttaaattactggtatagaagtgtgttcaagatgatgttatgttaggttggaagattaatttatgatataattttagtagtttgataaggggtgaaaatgtggattttttgataatagcttatatctatatgtttattttgggaagctgtattgccagttttatcaatgtattaatttatcgaattcctcgagatttggattttgttaatggacgaagtttttgccctagttgtcacaatacattaaaaccatatgatatgatacctgtttttagttggctgtttctaaaaggtaaatgtcgcttttgcaaagagccaattagcccacggtatccattaattgaattatgtggtggtttgttagcaatgttatgcttttatcgttatggttttacttggatgacattagttagttttgttttagcaatgattttattgacgattacaatgattgattttgatactatgactatccctaatggattagttattgctttggttgctccagttattgtctgtgcagttttagagcctcaaattagtattagtagtcgtgttattggaatggcatcagttagtgggtttatgttattaatgacattagccataccagactgttttggcggtggtgatatgaaactgatgtttgtttgtggatttatgcttggctggataaatactttattagctggttttattggactattagctggggggatttatgctagttatttgatggtaacaaaaaagtcaaaagagcagtcacacatggcttttggaccatatttgtgtttagggatatttatagcactattatatggaaatgaaataattagggtgtatctatcattttttaatttataagtgaggaagagaaatggcaatttataaatatgtagcacgtgatataaacgcaaagaaaataacaggaaaaacggaggctagggatgagcatgaacttagtcagcttttacgtgttaaagatatgtatttgatttctcataaagatataactaaagaagaaactaaaaattataagatgaaattgaaggaattagctaatttttgtcgtgagattggaacaatgatgaattctggattaccgctgattcgaacggtttcaattttagcaagccgtgaagataataagaaactaaaagcgatttataatgatatatatgtaaaattgcagcagggacaaacattatcagatgcattaaaagaacaggggaaagcctttcctgatatattaattcaaatggtaagatctggtgaagcgagcgggaacatgcaagatacaatgatggtcttaaataatcaatttacaaatgataataagattaaaaataaagttaaatcagcaatgacttatccagtcatattaggaatagttacaattgttgttttattgattgtttatacagctgtgttaccatcgttctttagtatgtttgagggaatggaattaccattaataacagaaatcaatattataattagtaaatttattatgagttactggtacgcactgttgattggcatcctagtattaatattaataattgtgtcattgttgcaattaccaaaagttaaatatcagtttgatcgctttaaattaaaaatgccgataattgggaaactaatgaaaataatttatacctcaagatttgcaagaactttatgctctttatattctagtgggatttcaattgttaatgcaatggtgatcgtaaaatctacgattggtaataaatatattgaaacgcagtttgataactctattaaagcggttagaaatggtgaggcattgtcagttgcaattggaatgattgatggatttgatattaaattaacttcaagtgtatatattggtgaagaaagtggaaaccttgaagacttactgagttcactagctgatgattttgattatgaagctatgttagcgtcagaaaaaatggttgctattttggaaccagctatgattattgttttagcagtagtaatttgtgtaattattatttctgtgttagtaccaatttattcaatgtatcaaaatgttggaagtatgtagggggactttatgaaaaatataatatatttatcgaatacgagtgcacaattggtcagtggtgtatgtaatggcagtaatcaaattgatattagtgattttcaagattatcaattacctgaggggactatgcttgatggtgcaatcatggatgaagatgctttaaaagatgtattgcgcataattaataaaaaaggaattggtgattgtaagctggttattgatagtggacaaatcgtgcataagaatttaattgttcctaagatcaaggataaagaaatacatgcaatcgttaaagaagaaattgatagcttagaaaatggtgaacatgatttgatctatgattatacaattttaaaagataaattagtagataaaccagggattgagattctttgttgtgcaatgaaaaagcagatgatagaagattatttaaatatttttgatgatgtggggattgaaataactgcaattgatatttctcttaatgcaatcgataagttaatagaagatattatcagactttctcaaagaaactttgttattgcggtgattaatggtaatgatatagctttatatttatttgaggaaggtaagtatgttttctcgaaccgttcaagattgttttctgagcgaggaagcagttcctttactatggaagtaagcaatattttaattaagtttaagcagtttattaaaacggctgattataatcaaaatattgaaagagtatatttttgtggattggatgattatgaagaaaaaatgctatttgaagtagtaagtgatagtgtcgatataagggcaatgcgcttagctaatagtaatacgatttattacagtggtaactctaaggaattcttactccataagtatgtttatgctattggaagtttatgtgaaaggtagggataataatgttcaagcgaaataaaagcaaagatattgatctactggaacaatattatctagctaccaagaaaaaaaatattttccaagaataccttaaatatcttatcttgcctttggttttagtattcattataggtggtgcttttggctatttaaaagttaaacaaggtaattataaaaatgatattgctgaaattaaacagaaaataagtgatttagaaaaaagttataaagatagtgattatgaagaaaaatatgcttcattgcaagaaattcaaaaaataattgataatctaaaaaaagttaatgctaatattgcttcttatcctaacttaagtgaagatatttataatgcttgttataaagcggctttacaaggcaaaattacttcaagtaattatgaacaaacaaccggggaactaaccttggttattgaaacaagtcaagttccatacacaaaacaaattgttaaaaacctgatggatctaaatatttttacaaaagtaagatatagtggttataaagaagtggaaaaagaagatgaatctagtaattctggttctatctatatgcctagtacaaccccagaaaaggtagttgtttatcaaatgacagttatctgtagtttaggaggagggatcaatgaataaattaagtagacgtgaacaaatcttgatttatatcttagtattactaatggtagttgttgtgggctggtattttatgatttctcctgctatggcaaaaaatacaacattaaaacaacagcgggataatcttgaatttgagttggaaagtaaaaaggcggtatatgaaactaatatagatgttaatgctgcaattaaaaaagcgaaagatgagttagtcgattatcataataaatttatgtcgattatgaatgattatgaaatagatgtttatttttcagaattggcagctgagtataacctaacaccagttgatttaacaatcaatgaggctagtgaaacagaaattaaatcttttagcgtggccttacaagaagcaaaagctgaaagtaacagtaaaagcgaaacaacttcaaataagagcgaagaaaaagaagaaaaccctaaaacgttagttgcaaatgtgcagcaaaaggttacaggaagccctacaaacattgctcgttatataggtaagatatctgaaaatacaggagttgcattaactcaattacagtacacttataatagggatagtactaaagaatatacaattttaacatataatttatatatgattgaaaaatgatatgaaggaggctaaatatgattaagaataataaaggctcagggcttacatgggcggtaatgatcgtaatgatattattattgattataggggcctctttaacatttgcttattcaagttataatcgttcgatcgataatcgaaatcaattacaatgtgatctatatgcaaagagtgctttagattcacttataaaagcaattggtgataacgaaacggatttaattcctaaaagtagtgcttttgaagataacatttatcctgaaatcagcttaccaaatgctaaaggagaagtatcccaagcggttatccatattgtagataaagagcaagaaaaggataatgataaaaagataatcccgttaatatatattgagattacttatgaatataatgatcgtaccagtaatgttcaagcagtaatgcaaaaaataggcggtatatggaaagttattaattatgacggaggtgaagccgcatgataaataataaaggaatgacgttagtagaagaaatagtagctttggcaataatttcaattgcctcattaataatgctggttggtttttctactgctgcaaatgtttttgctgatagtactcggtataaagatataactaataaacagtatgctgccttattaggaaatgagaatactgataaagatattaatgtttctaatgaagacgctaaggttattattaaagttgctgataaagttattactgttaagacaaatcagagtaatgctacaagtaaaaaagatagtcaaactatgttatcaaaattgaattttaataacataaatctttcaaatacgccacaaacagtagctaattgtaatgattttttagatagtgtactttcgtttacaactattaaacaatttgatgaatggatagcagagcaaggaattgatgtggcatcgtataatggctggtataaaaacaacgactgttatcgctattattactataatagatatggggctgcgcatttaacattagaacaggatattattaatgaatgtaatcggatttttgatgaggttcatcaaaccgcaactaatcaaaatgagaaaaaggctcgtatcggtgataaaacactatatattaaaccatatttttgtggcggtatctggcaagttggaattgatagcgaggatggctattttttaatggcatcagagttaccaggaattagtggtggaacacaatggcgaactaatttgatttatgctcgtggcagctggtattataaagtatttgcatttggtacaagtgatcaaaacagctatgtggatgtggcagggttcagtaatgctaaggcaactgtagatagtttatttgatggtagtattagcgaaaaaataaatttatctgatcaaagtcagtggataaaaataaagtaatcatagtttagaaataaagagggaaggggagattaagatgaaacaatttaagaataataatggtatgacattaattgaagtcacagttgttttattgatctctacggtcctcttgacgatcgttggctcgattcttgttacatcacttaatttttttcgagatcaaaaattaagcgatcaaaataaacaaaaattagatggaattgctgagtatgttgataatgaaattaattatgttacagatttagcaatcgataacgaggcaccgtatgaaagagaagaatggcactatttatcaataattgatggtaaattatatcgtgatggaataaaggtgtttgatgataaatactatgataattataccgtgtcaattaaggttaaggggtatgacgggtatcgtctagatgtaaagtatgattttaataaaaaaagtgagctagtctatggtactgctaaaagttattcttttgataatttgaaattaaaagttgaggctggaggagaagattatttagttagtgcatcaaatcaggtcgaagtaaatgatacgtataggatttattatatcaaggggataaatataatagatactaatgataagcctgatgtagaagaacctgatgaaagtaatgataatattacagtagctgatcaagtacattgtataaatacttataataatagaggtgtatttgatggagttcaaagacattatatgattggtgattttgtttattataaaggttattggtggcaattaatcactcaagaaaataattatggtttcggtgcagaaccggatagagaacaaaaatggaaaaaaattgataaaaattacgatagatttagtgcatatacagttaatgatgtaatttattatccggaaaatggacattactataagtgtttaaaacaattagacaataaaggtggcgattctggatatggacctactggatggaatgggattcatgaaaattattgggaagatttaggaacaacgaatcctactacagatagtggacatgactgcttagagttaagcacaaaaaatagaataaaaacggtaatgaacaaattagatagtttgactaaagaacaaattaacaaaataccagcatatttaaatacagttgtgtatcctgtaggcagttgggtatatgaggatgttgatggaagaaaacaatattatttaaaagtatttgatggtgatggcagtgctccaggcctttcagcatcatctggctggcaaataatttcaagagattggtatttggaaagtgcgtatattaaagatgatgtagtttatgttacaaatggtggtagatcaatatttattacatttaataaaactattgatctgacaatagacctagtcaatggtacaaatattaatggaaatagaattgatattgataatccatatagttattttaataaaaagaattctatgtattgataggaaggacgaaatatatgaggaatataccaattggtgaagtattaaaggaatatggatatataaatgatgagcaattaaatgtggcattagaagcgcaaaagtctaatcgaagtaaacgcttaggtcaacatttaattgatctgggatttgtaagtgaatatcaaatgttagaagctttgtccgataagttggcagaaccgttaattgaattaagcgaaataaaggttgatatagatgcagtacaaaagataccgcgtgcaatggctgataaatataatattattgcgattgatttaactgatcaacaattaactattgtaacaagtgatccattgaacttctatggaattgaagatgtacgtcttgttactggaatgcatttaaatgtttgtttagcaactaaagcagaggtatctaaagcgatagatcgttattataatgatgttgcagcattagatattgcagatgatattaagttaaatactattgttgttgaagatacacttgatctcttcaatgaatctgaagatgatacacctgttgtaaaactagttaatacgttattatctcgaggatatgtaaataatgctagtgatattcacattgaaccgtttgaagataaagtaattataagaatgcgggtcgatgggatgttggtggattatttgacactacaaaaaaatattcaaaattcacttattgtaagaatcaaaattctatctaatcttgatattgctgaaaaaagattaccccaagatggtcattttgtaggaagagtagagggattggaattaaatatgcgtgtatctgtaattcctaccgtatttggcgaaaaaatcgttatgcggtacttaaattcaaatactccaattacacgaagtgatacttacggaatgacgcttgataattataataagattgaaagtatgatcaatatgccacatggaatcatatatgtaacaggaccaactgggagtgggaaaacaactactctctatatgttgttagaatcaatttctaaaaggcaaatcaatatttcaacgattgaagatccagttgaaaaaaacttaccgcgaattaatcaaacacaggttaataatatggcgggattaacttttgaagtcgggttaagatcattaatgcgtcaagatccagatattattatggttggagaaacccgagatgcagaaactgctgaaatttcagttagagctgctatcacaggacatttagtattgtcaacattgcatacgaatgatgcagtcagtgcaatcgttcgtttggaagatatgggagttgagccgtacttagtcgctaattcactagtaggggttgtagcacaacgattagtacgtacaatttgtccgaaatgcaaagaagaagtaccagcgaaggctagtgataagattgctgttggtgaagatattaaaaaagtttcaattggtaaaggttgtccatattgcaataatacgggttataagggacgaattgctgttcatgagattattttaattgatgggacagtaagaaggatgatttctagaaaggctgaaatcgacgagatcaaagagtatttaaatttagaacaaggattagaaacattgcaagatcaagcggtacaattagttaaagatggaattacgacagtcgcagaattaaataaaattaaggtatatagtgattaggtgaaaataatgataaatgaaattttaaaagcttctcgaaataataaatgttcagatattcatattagtgctaatacaggaataaaggttcgtcaggatggtttattggcagattatccaattgagtttcctcaaaatgaattaatcaaaatgattatggagttaattccaaaacgattgattgataatgttgatcgtcatgaagatgcagattttgtctatcatgttggggaggaacgttatcgggtcaatatttattatgaacaaactaatatttgtgctgcaattagggttattaatgatgaaattttaacattagagcaattagaaatgcccaccgtgttaaatcagattgcaatggaaccaagaggcttagttttagtaacaggaccgacaggaagtggtaaatcaactactctagcagcaatgattgatttagtgaataaacagagaaattgtcatattttaacaattgaagatccaattgaatatgtttataaacagaaacaagcattaattcatcaacgtgaaattggtgaagatgtaaaagattttgatatggcattacgctctgctatgcgtgaagacccggatgttattttagttggtgaaatgcgtgattacgaaacaatcagtgccgttattacattagccgaaactggtcatttagttttctcaacgttgcacacgattggggcagctaagacaattgatcgaataattgatatttttcctcagcataaacaggctcaagttagaactcaattatcaggtgttttaaatgcggtaattacacaaactttattacctcatgcaagcggaataggacgagttgctgcggtagaaataatgcgtgctaatgatgcagttagaaatttaattcgtgataataaaggccaccagatcaattctgttattcaaacgggtaaaaaagaagggatgatatctttaaatcatgctcttgcaaatctagtgcgtgaaggaaaaataactttagatacagctaaaaagtgtgctagtgatatttcagagtttaaacagtatttacaataaattataaagggggctagagaatgaaaggcaagagaggtttttcattaattgaaatagttgttgttttgatgatttttgcgatattagcggctctagcctggcctgctttagcaaattattatcgtgatagtaacgaggaaatatatttagctgagggtgataaagtattgactgcagcacaagttgaagccaaaaaattatgtagtgaagtcaatggagcgacaaaattagatgatattgccttaaaagatagcgatggtaaaattttaaaaagaacggccttgaaaggggagctggtcagtatctatcctaatgatacacgtgatgatgtcggtttcttttgttataaggtagaggatggttcatgttatgttatatatgaaaatggtaaattgtatatatctaaagacgaagtctattatatggataatatcgctgatcgtgtccgacggggttttttaatattgtttggtgatatgtgggaagaatatttcagcaagagtggaaaagttgtaatggattctaatggaccgaattttggtattaaatatgaagccaaactaaaagaaatgggaattgatattagtttatgttcatttagaatttatgtgaatgatcatggtaaaaatggtgatggatctgacgcaacatttactttaacggtttcaagcaaacggattacaaatgaaatggctgaaactaaagaagaatttcaaataactcgttatatttttactggaggtattaaagagggaaattattcaaaatataccggaacagccaaagctgttttaaaaagtgagaacgacacgagtggtataagacataattatgcagttattgaagctaatgcgaattctttaaaaccagttaaataaattaatcatcgattataataattgatgatttttttgtttataaagattgatttaatatattttaaacatgtttttaacttgtatgttataattatgttaagcaatgaaaagtcattgtatacaataaaggaggggtttgatgaattttttatttatatcaccaatgtttcccaagaattattggaacttttgtgatcgaatgaaaaaccatggtgttaatgttttggcaattggggacatgccaaacgaaagtattagtgaagaacttaaaaattcagttactgaatactgttatgttaataacatggaaaattacgataatgtatatcgttgtgtagcatatttagcaagtaaatatggaaaaattgactggcttgagtcaaataatgaatattggttagaactcgacgccaaattaagaacagattttaatgtcaatacggggatgaaagaagatattaccaagatttttaaaactaagtcaggaatgaaagcttattatcaaaaagctggggtaaaaacagctcgctatcatcttgtcaatactttagaaaatggtaggaagtttataagtgaagtgggttatcccgttgttgttaaacctgacaatggcgtcggagcagctgcgacatataaaattaataatgatcaagagttggaggagttctataatattgatcatattacccaatatattatggaagaatttgttaatggtttgattctttcatatgatggaattgctaataatgagcatcaggtattatttgaaacatcacatgtttttcctaattcaattatggatgtagttaataatcatagtaatattcactattattctttgcgaaaaattcctgaggaattacaaaaattagggcgtagtgtagtaaaggagtttccagtgaacgctagattctttcactgtgagttctttcaattattagaagatcgacccggcttaggaaataaaggtgattttattggtttagaagttaatatgcgaccacctggtggttatacgccagatatgatgaactgggctaatgatattgatgtttataatatctatgcagatatggtcacatacaatcatagtgaatattatactaatcgttcctatcattgtatctattgtggacgccgtgatggcaagaaatattattataacgatgatgctttgatggcaatgtatggtaatcatattgtaatgaacgaaagaatgccggatattttatcgggagcgatgggaaattatacatatactgctcgctttgaaacaatggatgaagtaaatgattttattgataaggtattaaaggaggtctgttaatgaaagttgaatattttaaagaatatagtaattgtttaaatagagaaatggaatttaaaatctatgggcataccggcattccgctattagtttttcctgctcaagatggtcggttttatgattttgagaattttggtatggtaagtgtgattgcagacaagatcgaagcgggatcaatacaagtattttgtttagatagtattgatggggaatgttggtctgatgaaggcggaaatggaccgcatcgtacttatatgatggagcagtggtactattatgttatgaatgaactaattccaagaatttttgatattaatggtactggtcaaaaaatatatactacaggatgttcaatgggagcgactcatgcagctaattttatgtttaggcgacctgatatatttcaaggatgcatttgtttgagtggatattatgatagtgatttattttttggtaattatcatgatgagagactttataataatagtcctattcaatatttagaaggaatgtcatatgatcatccatatgtagaaatgtaccgccattgtgatattattctatgctgtggtcaaggtgcctgggaagatgaaatgatctattcaactcatcgtatgcaagaattattggagaataaggatattccagcttggattgattattggggatatgatgttaatcatgattgggactggtggcaaattcaattgccgtattttataaatcatattttatagggggaattacatatgaatgtagtatttatttcaccgcattttcctttatattttcataacttttgttctcgattaaaaaaccgtggagtaaatgttttaggaattggagatgctcaatatagtgagattagcaatgaaacaaaagaaagtttaagtgagtattatcgtgttaatagtttggaaaattatgatgaagtatataaagcggtagcttattatattagtaagtatggtcgaattgattttgttgaaagtcaaaatgaatattggttggagactgatgcacgaattcgcagtgattttaatatatgcagtggtactaaatttgaagatttggcagtgatgaaatacaaatcaaagatgaaagccgtttatgaaagtgttggtttgaatgtggcacgatattgtctaattgataattttgaaaatgctttgaattttattgatgcggtcgggtatccagttgtggtaaagccggataatggggttggagctacatctacttataaactgaataatcaagcagaattagaatatttttttgctactaaagatgagcgtatttatattatggaagaatatgtcaacggacatgttgaaacttttgacggaattaccgacagtaataaaaatgttttaatcgccaatagcacgattatgttaaattcaattatggataatgtaaatgagcattgtgacactgctttttgtaatcgttttgttgctggtagtgatatagaagaaattggaacgaaagtagttaaagcttttgatacaagaagtcgttttttccatttagaatttttcagacttgattcagataaagaaggtttagggaaaaaaggtgatttagttggtttagaagtcaatatgcgagctccgggggcttatatgccagatatgataaatttcagttatgaaagtgacgtttatacaatttgggctgatatggtaatttatgataaatgttttatagaactaaagcagaaatatctagttgcatatattggtcgtcgtaatgatattggttatatgtttgatcatgaccagttaattagtcagttcggtggaaatattatgcttgatgttgatgtccctgaagttttaagtgcagcgatgggtaatcatgtttacatggttagaacagaaaatcaagagcatttagactatttaattaatgaatttttgaagcgatgtgatggtagtaattggcgataatttaaatacatttttaaggtgttcaagttaaaaatattaccatattatcaatatttgttaaatttgtgttaaaataaatttcctttttgaaatttatatgctattataagggcggttcagtaatgaaccactttatcccaaatgtgcataagcacaaaatgaaggaagaatttattcttccctccccacaaagttaggacatcccagtcctaactcctttttattgaaatagtctagacaactttttttaagactgatataatatcatgtatagtgtcacggcccctctcccatataaaccgtgacacttttttcatattttgaaaagccttttataaatatgaaaaagaataatttttaaaattgataatgctaagatagtaatatcaaggaggaatttatacaatgaactttccaaagaattttttatggggtggtgcaattgctgccaatcaagctgaaggggcttatgatgaagatgggaaagggcttaatgttactgacgttagtacaggattaatcaatgtacctgactatcgtgttattcctggtaaatattatcctagtcatgaggccattgatttttatcatcggtataaagaagatttgcaattgatgagtgagatgggatttaattgttttagaacaagtatttcatgggggcgtatttttcctaatggtgatgatgaagagccaaatgaagcagggttaaattactatgaggaaatgtttaattatatgctggagctgggaatggaaccagttataacgatttcacattatgaaacaccaatacatttagtagaacaatatggtggctggaaatctagagaactgatttgtttttttgaaaaatattgtcgaacactttttaatcgttataaagatttagtaaaatattggatgacttttaatgaaataaataatgttcatacgattccttttgctgctggagcaatccgtcatgatagtaatctacaagataaatttcaagcggctcataatatgtttgttgcaagtagtcgagcaaataagctgtgtcatgaaattattccagatgcaaagattggttgtatgttgtcattaagtggtgtttatccagctacttgtaaacctgaagatgtaatgggtgcttataatttacgtcgtcgttcattatttttcagtgatgtgatgattagaggtaaatatccaagttatattaaacgaatttttgaggaaaataatattcagttggacacacgtcctgaagattttgaattaattaaagattacccttcacaatatttaggatttagttattatcgaacaacaacatatgaagatggaatgccaattttaggtaatactggcggtgtcattggaaaagctaatccatatttaaaagaaacaccatggggctggcaaattgatcctttaggattacgttatgtatgcaatgagctttatgatcgctatcaagtacctttgtttattgtagaaaatggaatgggaaatattgatcagattgaagtagatggctcaatcaatgatgattatcgaattgcctatattcgagatcatctcgaagctttaaaggaagcaattaaagatggtgttgatttgattggatatacttactggggtcctattgatattgtttcagcaggtactggcgaaatgaagaaacgttatggttttatctatgttgataaagataatcaaggtcatggaactttaaaacgttctaaaaagaaatcatttgaatggttcaaaaaagttattgcctctaatggtgatgatttaagttaattgtattattaaagaaaatatagtaagataaaggagcgaaaaaacgctcttttattatattgggggaagaatgatgaatttaaaattagtgatttttgatatggatggtttaatgtatgatactgaacaaattggaatggattgtttaatcaatgcagctcaaaaatttggttatgttattgatcaagaatttggattaagttcaattggcatgaatgctaatgattaccaaaaattagttaaagaaaaatttggtgctgattatccttatgatctaattagtaaagaatcacgtaaaacacgaatggcttatttaagaaaaaatggaatgataatcaaatctggtttatgtgaattaataaattatttacaaaaaaaagaaattaagcttgctttagcatcatcgtcaagtaaagagacaatcgatgagtataatcatcttgctggatttgataatgtctttgattacattattgctggaaatatggttgaacatagtaagccggatccggagatctttttaaaagtgcttgaacactttgagttgaaaaaaaatgaagctttgattttagaagattctcgtaatggaatcatggccgctcataatgcaaatatccccgtgatctgtgtacctgatttagttaaacatggtcaagatattactaaattaacatatgccacattaccttcattgaatgaagttaaattagaaattgaaaagataatcactaaataaaacaatgatattggaattggtgatttttgatatggatggtttaatgtttgatacagaaccattgggagcagtctgttttgcaagagcggctaaacaatttggatacataattgaagaagaatttcgctataagctgattggaatcaatgccaatgatcattatgctttgatgaaatcaaaatttggtcaagattgtccggcaaaagagattcatgaattatcaaaaaaacttagaagcgattatttatataagcatgggatcgtaattaaacctggcttatttgaattaatcacatatttaaagaataaaggaataaaaatagcagttgcatcttcttctgcctatagtaagattaatgaatatttagctttagctggtttaaagaatatttttgatttgattgttggcggtgatgatcttgaacatggtaaaccagatccggaaatttttttaaaagttttaaaatattttaaaatagcggctgatcatgctcttgttttagaagattcaacaaatggaatattggcagcaaatgccgctaatattccagtggtttgtgttccagattatcttcctaattgtaaagaagtattagctcgtacatctgctgtattaccatcattagtcgaggtgaaaaatgagattatgaaaatttttgaggaaaatcgggtatgcagttttttgtaaatgaaatgaatttgtgcggtattaaaaaataaggataataattatatattataatgatatatcactaattatattatgttcatttaggtaaagcagatgtaaaaaaaatagaggatattttaaggaaatgttactttttgggtaacgtttttttagtttttgtatctaaaatagatattgtgttaatttaattaagtctttgtaaaccgtattgttgttatattttatgaatgataagatgttggtgttaaaaataaaggggaatagacaatgaaaaaaaacaaagttttaaaagtttcaatggcgacattagcattgttgatgtcggctggatatgtagcgcaagattatcaagttacaccaacttatgctgaaacaacaaaaattggagattcagcgcaattgattagtacggcaacaacatggaaatatttagacaataatgttgatccgggaactgaaactgaccgttatgcctggacaaaagcagattataacgattcagagtggaaaagtgaagctggaaaatttggtgcaaaaaaaggaaaattagaagatttaggcgatggttttgtaccaacagttttattaaatcaatatattaatggggttaatggagatgatattccagcattcttctttagaactacagttaatattagtaatttagatgatttcagtagtctaagtgggaaactctattatgatgatgcagcaattgtttatatcaacggtgttaaggtagcatcgtttgatgaacctgagggtggctttgaatcaaacatgtcttatggcggttcaaatgctagtaatcctaaagaaggagttatttcactaacaaaagaacagttaaaagatgttattaagactggtcaaaatacgattgctgtagaattacatcagggtcgtgcgagcagttcagatatctattttgagtttaataatcttcaagttgattacggccaagaagaaacaacagttgaacaaaaggcgcttaatttaactatcggtgaagatgaaacaaaaatgaatcttacctggtacgctaatactaatacttcgggaactgttcagctggctaaagcaggagctatgatcaatggtgaattcccaagtcaatttacaacggttgaagctacgaataatcaggcaaacgataagggattttactataaccaagcaacattggctaacttagaagaaaatactaaatatgtatatcgcgttgttaatggtgatcaagtgagcaaaatttatgatttcacaactaaagattttgatggaagttataacttcatctttgcaggtgatccacaaattggagcaagtggtagtgcttcaaaagatacagaaggatgggataaaacattaagtgattcaattaataagtttaatccaaacttcattctttcagctggtgaccaagttaatactgcaagtgacgagaatcaatacagtggctacttagatcatgaagaattaacaagtgtacctcaggcaacaacaatcggaaatcatgatagtagttcaaatgcttatacacaacatttcaatttgccaaatgaaactgctaaaggggaaactgcagcaggaactgattattggtatgtttataataatactttatttatgaatatcaatacaaataatacaagtaccgcagaacacaaagcatttatgaaagaagcaattaaggaaaatcaagatgttcgttggaaagtagttgttttccatcactcagtttattcagttgcttctcattcagtagagagttctattttaaaacgtcgtgaagaattaacacctgtatttgatgatttaggtattgatgttgttttaatgggacatgaccatgtttatgtacgtagtaatatgatgaaaggaatgaaagttagtcaagaaacaaaggatttaactagtgtaacagatcctgaaggaatcttatatttaactgccaattcagcaagtggcagcaagtattatgatatcaagactaatattagtactgactttgttgctaaaatggatcaatcaaaacaacgttcaatttcaaatattgaagttagtgaaaatagttttaaagtaacaacttatttatacaacagtaatgataatcaatggtcaactttagatgaattcactattaataaatcagttgaaacaaacaatcaagaaattacattagtaccagaagaaacagcaaatgatattagagtagttgctccagtaggaacagttgaaaaaaacagtactttatcagcagttgaagtgaatgagggtgacttatatcaaggaattaaaaataccttaaatactattttaggtagtgataaggattttaaagtatttgatctatcactaatcaaaaatggaaatattataaatccattaggaaaggttcaattatcattagcactaccagagggatatgatgctagtaagttattgatctatcaagtacaagatagtcaaaacaatgatataacactaaacccgattacatatacaattaaagatggacggattattattgaaacagcttcattaggacaatttgttttagttaacaatgtagaaaataaaaagccagatacaggtaatggttcaaatactaatcttccgacagttaagccatcaaatacaaataattctactacaacgacaaataataaggttgtaaccggtgataatagtaatcttattgcttggggaacattattgtttacagctttgggatgttcattagttgcttataaatcaaaaaaagaagaaaagttaaaataactagtggtaatcattgattaccactaacttttattagaggtcatttatgaagatatttaatgaattaaaagagaatcgtgttgttattatcattatgctcattacgataattgcagctggtttttttaatcaatatttagctaaggattattctcgggttaataacgattcaactgattttgttagcgggaagatagtagaaataacgagcagtaatcttgaatatgatcaagatttaaaaataaatcttggaaaacaagtagttgtggttgagattcttgaaggaaaaagtgcaggaaaaagagtagagatcgataattatctaacagctgctcataatgttgaagttgcgattggctcgaaagtgattatctcagctgatgaaccagatggaatagactcgtattatacggtttataattttgatcgtggcttaggaatgattatttttacttgtgtattattgcttgttatcattgcaattgggcgcggaaaaggggttaaagcaatcttaggattagcttatacattatatttagtaatttttctattactgccaactgtattttcaggttactcaccagtattaatgagtattatctgtgttgctttatcaacgattgttacattaatgttgttaaatggtgcttctaaaaagacttatagtgcaattgtggcaacagttttaggggtagttttatcggcagggggattttatttaatgtcattagtactaaaagttaatggttttagtgttgatgaggcagaaagccttgtgttaattaatcaagctacgggattatcgattaaagatattttatttgctgggattttaatttcatcattaggggcaattatggatgttggaatgtcaattgtttctgccttatcagaattatttcatcatcagccaaacttgactcaaaaacaaatttttgattcaggaatagaaattggtaaagatatgattggtacgatgacaaataccttgattttagcatttactggtagtgcatttgtttcattattagtcttattttcatacaatgtcgacattaaacaactattaagttctaattatattgcaatagaatttgctcaaggaattgctggtactttaggaatcgtattaactgttccaattgcttcgtttattagtgcctgggcattaactaataaaaagagtaataacaattttttcaagagttgaaaaaaattttgtaatatctgaataatcagttaaaatgtacatgacataaacaaggaggtattatatgagttttccaaaaggatttttatggggtggtgcaactgctgctaaccaattagaaggtggttggaacgaaggtggaaaaggaatttcatgccctgacatttgtactggtggaagccatactcaaagtaaaagaattacaccaacattagaagaagggactttctatccatcacatatggcaattgatcattatcatcgtttcaaagaagatattgctttatttgctaaaatgggatttaaagtatatcgtttttcaattgcttggacaagaatttttcctaatggtgacgaaacaacaccaaatgaagaaggattaaaattttatgaagatttaattgatgaatgcttaaaatataatattgaaccattgatcacaatctcacattatgaagtaccgtttggtttaacaaagaaatgcaatgcttgggcatcacgagaaatgattgactattacatgaattattgtaaaactatttttgaacgctataaaggtaaagtaaaatattggttaacttttaatgaaattaatagcgcaacgatgccaatgggagcttttttatcacaaggaattttaaatgaacaagaaaaaagcactgattttacaaatcaggttgatgatccccaattacgttttcaaggattgcatcatcaatttattgctagtgctaaagccgttcaattagcccatgaaattgatcctgattataaagttggtaatatgatgatttatgcaacatcatatccattaacttgtgatcctgatgatatcattaaaaatcaacaacaaaatcatatcatgaactatttctgtagtgatgttcaatgccgtggatattatccaacatacatgaagcgttattttaaagaaaataatattgaagtaacgatggagcctggggatgaagaaatattaaaagctggaccagttgatttctatacattctcatactatatgtcagtatgtcaaacagccgatccaactaaaggggctggtgaaggtaatattttaggcggtgtagcaaatccatatttaaaagcatctgattggggatggcaaattgatcctaaaggattacgttattcactaaatgaaatctatgatcgttatcaaattccagtaatggtagttgaaaatggtctaggagcatatgatgaaatcgaagcagatggttcaattaatgatgattaccggattgattatttgagaagtcacattgaacaaatgcatgaagcaattctagatggtgtggatttaattggttatacaccatggggatgtattgatttggtatctgcatcaacaggagaatatgctaagcgttatggtttcatttatgttgaaagatatgatgatggaacaggtgatttttcaagaagagagaaaaaatcatttaattggtataaaaaagttattgaaactaatggtgaagatttgggataatagatgtgcatagcacatctattatttttatggaggaaaaatgaaaactaaaggatattttttaacaattttatcagcagttatttttggctttaccccgattcttgctaaaataacttattcaatggggagcaatggaattacaatggccttttttcgacatttatttgtaataccaatcttatttttaattatgaaatgccaaagattgccttataaaataactttacatcagttaaagaatatttgtttagtaggaattattggtaatgctttgactgtagcggcactatatacttcatacagttttattcaagttgggagtgctacggtacttcattttctttacccgatgtttgtttcattaatatgtttcttttattataaagagagattatctaaagctgttaaaatatgtttaggaacagctagttttggaattttattttttatcgaattgggtggttcatcttttttaggactatttttggctctgttttcaggtataacatttgcttattatatggtaggtattgaaaagttaggattacagtctttgaatccttatgtattaaatttctattttgcaatcgttatttcaatctcattattaatgattggactgatcagtggtcagcttgaactgattttaccagttgaagcatatggctattctttcttgattgcagttttaacatcaatcgttggaattatctgtttacaacagggggttagatatttaggtgcagctacagcgtcaatcttaagtatgtttgaaccggtaacaagtgttatttttgggattattattctccatgaacagttaacaatcgttaaattaattggatgtttcattattttaagtgcaattactggtctgattgtttttaacgggaagcaaactgaataatttttaagtaggaggaaaacttctgcttttttatttatgtttaaaaaaacaagtaataataattatatatggtgtttaaacgagttgtttgtgataaaattataaataggaaaagttacgcagggggattttttaatcgtccctatttttgtttagaaaggagcactttatggaagacataattattattggagcgggagtaacgggctgtgcgattgctcgtgaattgtctcgagatcaacgcaaaattcttgttcttgaaagaggtagtgatgtttgtgtaggtacatctaaagccaattctggaattgttcatgctggtcacgatgctaaacccggaaccttgaaagcaaaattaaatttagaagggaatttaatgatgccgcagttagctaaagatttagatattccctttgtccaaaatggttcattagtattatgttttgatgaaagtcaatttgaagctttggaagaattataccagcaaggcttaataaacagggtaaaaggattgaaagttttagatactaaagaattacttgagatggaaccaaatttaaatcctaatgttttaaaaggtctttatgctccaactggtggcattatttgcccttttgatcttgttttggcattagccgaaaatgcttatgctaatggtgtgaaatttaaatttactcaagaagttgtgggaattgaaaaaaatattgatcattatattgttaaaactatggataagtgttatcaaagtaagatcgttattaatgctgcgggagttaattgtgatttgattcataacctaatttgcaatgagaaaatgaaaatagttccacgtaaagggcaatatgttttatttgataaaaccgttggctcaatggtaagcaaaacgatttttcaattaccgactaagttaggaaaaggggtattggttactccaactgtacatggtaatttaatgattggtcctgatgcaattgattgtaatcgtgaagagatcaatacaacgatagaaggacaaaaggatattgttgatcgcgcatctttaagcattaagcaggttccttatgcaaatcaaataacttcttttgctggattaagggctcataatacaacaggagattttataattaaagaggatctagataatccaggatattttgatgtggcgggaattgaatcaccgggattaacaagtgctccagcgattggcaaatatgtttatgatttagttggcgaaaagtatcctgcaaaagctaaagaaaattttattaaatatcgcaaaggaattactaaggtgatggaattgccacttgaaaaacgtaaccaattgattgcaaagaatccattgtatggccaaatagtatgtttttgtgaaaatgttagtgctggagaaataattgaagcaataaatcgtccactatccccaactacgatcgatggattaaaaagacgaattcgtgtcgggatgggaaaatgtcaatccggtttttgtttaaataaatcaatgaaattattaagtcaggaattaaataaggatatttttactattactaaaaatggtaaacattcaacctatttggtgggattaaataaggaggtcaatcatgaataaagatttagtgattattggtggtggaccggcgggaatggccgctgctttaggggcatatgaagcaggtgtaaaagatttaattattattgagcgtgatgagtgtttagggggaatcttaaatcaatgtattcataatggttttggtttacatacatttaatgaggaattaactggtccggaatatgctgaacgttatcgacgtcaaatagatgaattaaaaataccctatctattaaatacagtagtaattgacttgaatgacaaggttataactgcgatgaatggaacaagtgggacatttatgattcatgctaaggcaataattttagctatgggatgtcgtgaacggagtcgtggggcattaaatattcctggttaccgtccaagtggtatttatagtgctgggacagcgcaatattttgttaatattgatggctatatgccggggaaagaagtagtaattcttggttcaggagatattggcttaataatggcacgaagaatgacacttgaaggtgcaaatgtaaagatggttatcgaactaatgccgtattctagtgggttgaaacgtaatattgttcaatgtttagatgattataatattcctttaaagttgtcacatacaattattgatattgaaggaaaggaacgacttgaggctgttattgttgcaaaggtggatgaaaatcttaacgtaatagaaggcagtcaggaacgcgtttgttgtgatacattattactctcggtagggttgattcctgctaatgaaattagtactaaagctaatgttatgctttcaagtttaactaagggagcgattgttgatgattatttgcagacaaatcaaccggggatatttgcctgtggtaatgttctgcatgttcatgatttagttgattatgtatctaatgaggcaaagctggcgggaataaatgcggctaaatatttgcgagaccatcttgttttgtgtcaaactattacgatttcatatgaatgtggtattcgctatgtagttccttcagtaattcatcctaataatggcgataatgttattgttcgttttagagttgataaggtttatcaaaataaatatctatcattgtatctagatggtgataggaagattcatcaacgtaaattagtacttgcacctggtgaaatggaacaaattgtaataaaaaaagactggttaaacgaacatattaaaaaaatcttaattacattggaggatgaatgatatggaagtgattaaactgacttgtataaattgtccgttagggtgtgctttagaagttcggtatattgatgaggaatatgtggttacaggtaatcgttgtatccgtggtaaaaaatatgcactagcagaaatttctaatcctactagaattctaacaacgacaattagagtgaaaaatagtccttatatgttaagtgttaagagtaatgggggaattgccaaagataaaatttttgaatgtatacagatactaaaggaaatcgaagtacaagccccaattagtatgaatgaaataattgttgctaatattttagatagtgggatagatattgttgcaacaaaatcgattggaggagatgagctttatggctaaatatgtaatggctttagaccaaggaacgactagttcacgttgtattttatttgatcaaaaaggaaatataagtgcgatggctcaacgtgagtttaaacaaatttttcctcaaccaggctgggtagaacataatcctatggaaatttggtcttcacaattagcagtagccagtgaagcaatggcattgaataatactaaagctgacgaaattgcaggaataggaataactaatcagcgagaaactacaattgtttggaataaagatactggggagcctatttataatgcgattgtttggcaatgtcgaagaactgcagcaatgattgagcagttaaaaaaagatggtttagaagaaatggttattgctaagactggtttaattcctgacgcatatttttcggcttcgaaaattgcttggatcctagaaaatgtcgatggcgctcgagaattagccaatcaaaataaattactatttggtactgttgatacttggctgatttataatttaacaggtggtaaaattcatgtcactgattatacaaatgcttcaagaactatgttgtttgatatccaccagctgtgctgggatgatgaattattagcatatttcaaaatacctaagagtatgttgcctgaagttaaaccatcaagttgcgtttatggatatacaaaagaaggaattttgggtggacatattcctgtttcgggtgctgctggagatcagcaggcagctttatttggacaatgttgttatgaaccgggcgaagctaaaaatacttatggaacagggtgttttttgctaatgaacactggtaatgaaatatatcattctaaaaacggattgattacaacgattgcagcaagtgataacaatgaagttagttatgctttagagggcagtgtttttgttggcggagcagtaatgcaatggttgcgtgatggccttagaatgttaaaaagtacacctcagtcaagcgattatgctaatcgagttgaagatactaatggtgtctatttagtgccggcctttacaggaatgggtgctccatattgggatccttatgctcaaggaactattgttggactgacaagaggttgcagtaaagaacattttattagagcagctttagaatctattgcatatcaaactaatgatgttttaaaagcaatgcaagaagatactgggattgagttgagatgtttaaaagtagatggtggggcaagtcaaaatgattttctaatgcaatttcaaagtgatatatcaaattgtaaagttcatcgtccacaggttgtagaaacgacagcattaggagcagcatatttggcaggtttagcaacaggtttttgggctagtaaagaggagataaagaataattggaaattaaattatgaatttgttccaaggatcaacaaatctagacgtgaaaaaagtctggaaggatgggctaaggctgtacgttttgcgttaatgtggaaagatgcttaggagagcaaggctctcttttttattttagtagttatagtttcctaattttttggtgcatatcagttgtaaataaatacaaatgatgggtatgataataatataaaaaataaggagactgaaaaaatgagtaaaattattgttattggggcaaatcatgcaggaacagctgcgattaatacgattctagataactatgaagatgacgtagttgtttttgatggaaacagcaatattagttttttagggtgtggaatggcattatggatcggaaaacaaattgatggaccagaaggactattttattcaagtaaagaattattggaagaaaaaggtgcaattatatacatggaaacgatagtggaacatgttgactatgaaaaaaagattgtctatgcaaaaggtaaggacggtaaagagtatcaagaaagttatgataaattaattttagcatgtggatctttaccaatgcgtccaacgattcctggtagtgatttagaaaatgttcaaatggtaaaattatatcaaaatgctcaagatgtaattgaaaaattaaataatcctgagttaaaaaacattgtagtagttggtggtggctatattggtgtagaactggctgaggcatttagacgttgtgataaagaggttactttaattgattgtgctgatacttgccttggagcgtattatgaccattcatttactgatttaatgaatcaaaatttaacagaacatggaattaaattggcattcaatcaatctgttttagaaattaagggtaatcaaaaagttgaatcagttgtaacagataaaggtgaatatgctgcagatatggttattttagcggttggctttaaacctaataatgagttaggaaaagatgtacttaaactatattctaacggggcatatttagtaaacaaaaaacaagaaacatcattaaaagatgtgtatgcaattggcgattgtgcgactgtttatgataatacgattgatgatgttaactatatcgcattggcaacaaatgcagttcgttcgggaattgttgctgctcataatgtttgtggtcaaccactagaaagtattggagttcaaggctcaaatggaatttgtatctatgatttaaagatggtatcaacggggttaactttatcaaaagcaaaaaaattaggttttaaggctacttcagtatcatatcgtgatcttcaaaaaccggcatttataaaagaaaatcaagaagtaatgatagaaattatttatgatgaagaaacaaggcggattttagggtgtcaaatggcatcaaaatatgatatttcgatgggaattcatatgttctcattagcgattcaagagcatttgacaattgataaattggcattgcttgatatcttcttcttgccacattttaatcaaccttataattatataacaatggctggattaactgctaaatagaaataacaaaaatacatctcaatgatttgcatcaaaagcaatttttggatgtatttttattgtgctgaagtatctatgttaatcaatattatgaggtatagaaaatgaataatattgttgataaatagagaatacttgtttgtaattataaaatttcatttatatttgattaaatgtatatttctaaatagatatatacatttttttattctctaagtattattttcttataaggaggaatgtgaatgaataaatacgcttatatccgtgtatcaaccaaagatcaaaatattgatagacaaaaatttgcgatgaaagaaattggattaggtactagacaaatgttcatcgataaacaatctggtaaggattttaatcgaaaaggttataagaaattggtgaaaaaactaaaaaaaggtgatgaactttatattaaatctattgatcgattaggacgtgattatgatgaaattattgaacaatggcgatatttggtaaagaagaaagaagtggagataattgtgttagattttccacttttagatactagaaatcaagttaatggtattacaggaaaattcattgctgatttagtattgcaggtattgtcgtatgtcgcacaaatagaaagagaaaatacaaaacaaagacaagcagaagggattaaggctgcaaaagaaaaaggggtcagatttggacgccctcaattaccttatccagaaaattttgaagagatttatttgtgttataaggaaaaacagataagcaaaagagagtgtgcaagacggttaagtaccaatcatacgacattttctaattgggtaaatcggtatgaattaaaaaaagaatagaaaaatagaagtatttgtaaaataaggtagatttttttatccacgattgacaaacatggtagacttttatttccgtgtattatttccaataattatgctagaaacacataaaaatataactgtatttttctattaattattatatataaagtggaaaataatgtctactttattttccatcggaaagatagctgtacttttctggattttgaaactaacctaacatcggttaagttagaaaggaaggaggaaaacgaggtgcagttgaaggtttctactgattatgcaatacgaatagttctatatatcgctataaaaaaggatattgtccagtcgaaagaattatcagaaacacttgggattccccaaagtacagtatttaaaatcgggaagaaactaagtgataatgaaataattagcattgctacagggatacagggaggatttaaattaaaaaaacacccaaaggatataagtatttttagcattatagatatatttgagccaacgataagaattaacagttgtcttgaggaagataaatattgtagcagatttgctacagaaacttgccctgttcgaaaagtttattgtacaatgcaaaaacattttgaagaatatttaaagaaaataaaaattttagatttgatttaaaataaggagaaactgaatgttgtatttaaaaagaatattaatagttggattatcttttgtagtaggacttataaatattattggaaataattatacagtatttgctttagaaaagaatacgctggttcatcagaatgttatgtcaatgatacagtctcaacgtgggggactatttgacccgatttatacagagagtttagaggataattggcaaggtgattatatctactatggagaagatacggatggttcagcattgaaatggcaactcctagattcagataataaggattttagtaagaatgcaaatagtactatgtttttgttctctgataagactattggaactagtttttggtatcgtgaaaatgattatggttttgattatagtaatgtaaagccaggggaaactcctatatattggcaaaaaggctatgaatgggacaaaagtgatttaaagactaatatggaagatgaaatgaaaaataagttttcgtcaattgaaaatgagggcattattttttcttcaaaaagtagtgaagatgcacaaaatgtagcggttggtttggaaaaattaggtactacagaaatgactgctagtaaatggtttcctttaagtatacaagagcttaccaataagtgttatggttttagcagtgttccatttaatagaaatcaagcacctcttggattacatactggagataaaagtcgtgttagttctgatgataaaaattatttaatacgttcatatgaggaacattggacaaagccaatggaaaatggaatgcggtatcatcctgtatttgtgttaaatagtaacagtgtatatggtgcaaattgtgctggaggattaaattatggaaatatgtacacagtacaaagtatgcgtccagcaatgaacatagacacttctaaagttatgctggttaaaagtcataatcaaaaagagattattggtattaaagcagtcaacgatagtaagacaaatgagtttaaattaacattacttgatgataaacaaaaattaaatatagaaaatattaagaccgaacgtgataagataacttttgattttgaagcaataggaaacggaaaatacttgagtgttgtagttcaagatgaaaataataatgttatgtattatgggaatataaaagataatctagacaaagtaaatgtaggaacaatgacgattgatttaaatcaaattggattgaattctaaatcatttagttcaggagaatataaattatcgatttttacagaacagttgaatttcgataaaaagacggattattcaagcaaatttgtagacgtagaagttgtacagaataacgtaccacccgctgttattaataaagtaccaacaattgtggcagaagataaagtactgacagtgggagatacatttgatccactgaaagatgtgacagcatatgataatgaagatggaataatcaagttaacggaagcaaatattgcagcaaatgatgtaaatacaaataaggaaggaacatataatgtaacttataaagtaacagataaacaaggtgcttcatcaactaagacaattacaattgatgtaatagaacgaatagttataccagaaaataaaccagtagataagacaaataatgatacaaattcttctaattctagtaaggtgccacaaacaggtgatattaataatataggtgtcttagcggtcacacttatgatgtcaggaagtatcgtaataggatgtaacagaaagaaaagtaaggctaatagtctaagcgaaaaataaaatattaaaaaaattaatattttttaaattagccatctagtattagcaagatttaaaaatacgctaaattgataaatatttatatttattagattaaaattgatttatctctattatgatgttctaaaacttataagggtagatatagattattgataatataaagacagccccattaaatgtagtgaacccttctagttggttgtgatgtgtacccagttttctggacacgtttaaatttagttttaaaaaaattatgccatggatgctaatctgtacaaaacaggtggcatccattttgttttttctgtattcttttattgcagtagaaaactatgaaaatgaatacaattcattttcatacccataatagacttcattttttaattggccaaagaaagtttccattaccgaattatcataacagtttccttttctagacattgattgtattatactgtgttcttttaatgaattgatataatgagcatgttgatatttccatccctgatctgagtggaaaatcaatccttcaaggatgggaaacttttcatatgcctgagtcagcatatctgtaatttgtttaagattaggatgcggtgataaatcataggaaataatctcatttgtaaacctatctaatattggagaaatataacattttccccatgcaaaattgaattgagatacatcagtagtccatttttgtaatggtctactcgtattaaaatttctattaataatattatctgctacattccctttataagaatggtatctctctttaggacgtttacctaataatcccatattatgcataagtcgttacactctcttatgatttaccagataaccgcgatttagaagctctctatgaactcgacgaactccatagcgtccccttattttgatcaaagatttcttttatcagtttcatcatctcatgcctttagaagatgctttaatcgatatcctttttcacgaatttctttaacgattgctgctcttaaacgtattagttcttctttctcaggaggagtaagttcacttgatattatagattttttcagaggctgctccttactatgtcgtcccttctttaaatcgagaccattatatccatatattttatatcgttttacccagtttgacaattgactgtgattaatattagcacttattgcaacactttttttgagattctccagctagaaccctggcaactaaagcgtatctttcttccacagtatactcagtgcaggtggtaggatgttttaaagcatctattccatgtaagtcagcgattttgacccatgtagtaattccttttctaaagtttttttgtccaattccttctggtgtttcatgccatcgaccatttttatatagttcaacacacttcaacttaaatacataatcatatttcatataaaaaccctccttactggtttgtccagtaaagagggtacgcatcattgcccaaacagaggggttcactacatattaggaggatgtttttatattaattttatttttcttcagtaataaacattttgtaaatagcacgaattgcatttttgaaatgaatattttttacaccaacaataatatttaattctgatgaaccttgatcaatcatttttatgttaatattttcttgagccagggctgtgaagattttagcagcagttccacgaccatctttcattccgcgcccaacaattgcaattaatgctagatcagattctaattcaattgaatctggttgaactgcacgatgaataccggctaaaatttcctgctctttatcaataaaagattcagtctcaacgacaattgtcattgtatcaattcctgaaggagtatgttcaaatgataaatcattatcttctaatacttgtagtactttacgaccaaaaccaatttcactattcatcatatctttttcaatcatgattgtagcaaatccctttttaccggcgattccggtaataacatgatctggtttatgacaagttgtttcaacgatcaatgttccttcatcttcaggacgattagtattttttatttgaattggaattccttcattacgaattgggaaaatagaattctcatgaagaacacttgctcccatataagataattcacgtaattctttgtatgtaattgtaccaatagtatcaggatctttaacaattcgcggatcagcaatcaagaaaccagaaacatcagtccagttttcatataaatcaacatgaccatttcttgcaacgattgaaccagttacatcacttcctccacgggaaaatgttttgattgttttgctgccatcattagcagaaccataaaaacctggaataacggcatttttaacgttacttaaacgtttagataaaactggatcagtcatttcttgatcataattaccatgttcatcaataaagataacttcactagcatcaataaattcaaaaccaagatagttagctaatacaattccatttaagtattccccacggctagcggcataatcaattccaattttatcttgaaaagctttcttaataatttcaaattctttttctaaagaacaatttaattttaattcgtcaataatatcttgataacgagctttaattaatttaaatgtttcttcaaaagtcttattatctttagcattataagcttgatataataggtcagtcactttgatatcatctttaaatctttttcccggtgcggatggtaccacgaaacgacgagatttatcacttttgataatattagctacttttttaaattgagttgcatcagctaaagatgaacccccaaatttaacaattttattcatactgttcccctttatataaatgtttaataaaaaaataccattttttagtggttacatcaagaaatatttaagaaaatgataaaataaatgaacttgtcaaagtattttcatgaattgaaatatttttcagatgatgaaaggactaattagagataaggatgatacggtataatgataaatatattaaggaggaataagaaaaaatgagttttcctaaaggatttttatggggtggcgcaacagctgccaatcaatttgaaggtgcatataatgaagatggtaaaggactaagtactgctgatgtaatgactaatggaacgcatcaagaagctcgtagaattacatacacgatgcctgatggaagtaaacatagtcaagcagtaatgccatttaaatcacttcctgatggtgcggtattagaatgtcatgaaggtgaatattatccttcacatcaagcaattgatttttatcatcattatcaagaagatattaaattatttgctgaaatgggttttaactgttttagattatcaatcaactggggaagaatctttcctaatggtgatgatgaaacaccaaatgaaaaaggactagaattttatgatcgagtttttgatgaatgtttaaaatatggaattgaaccggtagtaacaatttctcattatgaaacaccattaaatttagcaaataaatatggtggatggttagatcgtcgcttagtaggcttttttgaaaaatattgtgaaactatttttaagcgttataaagataaagttaaatattggatgacttttaatgaaattaatattatggattttatgccaccgtttgcaggtggagtcttaaaaaatgatccacaaagccgtgctcaagccgtgtatcatcaatttatcgcaagtgcaaaggttgtaatcatggggcacaaaattaatcctgatttcaagattgggatgatgacagcttatggatcaacatatgccttaacatgtaatcctgatgatgaattaaaattaatgttatctgaccaacaaagacatttctttagtgatgttcaatgtcgtggtttttatccagcttataaattaaaagaatttgagcgtgatggagttaaattgattaaagaacctggtgatgatgagattttaaaagaaggaacagttgactatattggattttcatattattcaagctctgtagtcactactgatgaaagtaaaaaagtaacggatggaaacatgtctacttcagtacttaatccttatttaaaggcaagtgattggggttggcaaattgatccaactggcttaagattagctttaaacaggttacaagaacgctataacttacctttatttattgttgaaaatgggttgggagctattgataaagttgaagcagacggctcaatcaatgatgattatcgtattgattatttagctaaacatattgctgcaatgaaagatgcggttgaatatgatggtgttaatttaatgggctttactccatggggatgtattgatttagtttcagctggaactggagaaatgcgcaagcgttatggtttcatctatgttgataaggatgatgatggtaaaggaccactaacaagaatgaaaaagaaaagtttttattggtatcaaaaagtaattaaatcaaatggagaagatttaagtaatcaataatttaataattcttggtattgtgttacatttgtaacatatatcaaggattttttaaaattaatttttcatttaaaatgataaataataaatgagcagattgaaatttattatagttataaaattatgagggtgatttaaaagcgctgatgtcttctatgtaggattattgaataccgggattgcccaaaaaatgtattgaaacacatagtatagtgatgaaatagaggtaacttctatccttaatcaaaaaatattctttacaattgacttatataaataaaagggaatgataatgattatatttcattatcattcccttttagtatttttggctacttttatattttaacatattcggcaaacaaaaacattaaatatttaatgttttctttttgtgcaaaaaatattttttgtatagacaaaagtggtatgatattaataaagaagtcataacataaggaggataaaaagttatgaagaagttagggaaagcgatacttggcttagctttagcactgtcgatgtgctttagtatgttcattccagtgtatgctgaaggggaaacagtagatacactagttggcagtttaatcggttattatcgagatggtgctagaacagacgttttgagaactttggatactttaaaagaggtttctaaagatgattatgatcaatggcaatcaatcattgattattgggactggattgaaaacgatatggtcgaaaatattggtgtagctcctgatggtctaccaaatgataatacccatgcttttgttgtactaggttttgcattaaagagtgatggaacaatgcagccagaattagtaggacgattagagactgctttggccagtgctcaaaaatatcctaattcatatattttagtaactggtggtgtaaagaaaaacggttggactgaaggggaccggatgcacgactggttagttgaacatggtgtagcagataatcgaattctagttgaaaataaatcagctaatacagcacagaatgctgaatttagttttgatattctttataatcatccaacaattaagagtatttctatgattactagccaatatcatttaaaacgtggaacaatcttatactatgcggaatcattaattcgagcacgtgagttagggaagacgccaattaaattaaatggtaatgcaggatggtaccgggaagataaaactagtgaaacattatcacaaaaagctagcagtttatcacaaattgctggagtttctattccttatggtgaaaaattaccaaaatctaaattaacaggaattgaagttactggtaaaaaaacttatactgttggagatgcattagatatcatagttacttcaacttatgatactgaatatagtcgtgatgttacaggtcttgctaaaattattggatttgatgctaataaagtcggtaaacaaaatgtagttgtagtttatacggaaactttacatcattctacaagtagttctgaagatgtaactatgacagctgaatttgaagttgaggtaaaaacagctccaattacagttccagtaaacccacagccaaccccagataaacctgtaaatgcagtaaatactggagataacagcccattggcaataatgacgatggtagcagggttagcagctgctggaatgtttttagcaaaaagaaaagaaaattaatagctatagtgaaagctgaatcgcaaaatgattcagctttttttagtatatcaatgataatggaattaagttttatttattgaataatatttgtttgaccgtaatcttaaaatattgtaagattatattaataagacgggaactgcccgtcattttctttaggttagaggttataattatgaaagataaaaaattaacaatgagtgatattgcaaaaatggctggtgttggcaagagtacagtatcacggtattttaatggtggttatatcaaagaagaaacgcgtttaaaattaaaaaaagtaattgatgaaaataattatgaaccgagcacattagcgcaatcattgaaagcaaaatatactaaggtaattggtattgtagtaccttgtcttgattcaattacaacatctcgtgttttgatgacgatggatcagtatttaaaagatcatggttatacaactttaataataaataccaatcatgatgaaatgcgagaattaacttcgattgaacagttatggcgaatgaatgttgatggaattattttaatggcaacggcagtaacgatggcacatcaaaatattgctgcaaaattagatattccactattatttgtggcacagcgttatggagcaggagtctctatcattaatgatgattatagtgctggatatgaagttggaaaatatgcagcatatatggggcatcgtaagatttgttatatcggtgtaagtggtaaggatgaggctgtaggaatttatcgtaaagatggtgtgatcaatggtttaagggacaacggagtaagcagcgttgatttattagaaactgatttttcattagaaaaggctcatcttattgctcttgattatctaaaaaagaaacagccaactctatttatcggagcaactgataatatcgctttggggtgtttaaaagcaattaatgagttaaaattaaagatgcctgatgacatttctttaattggttttgggggttatgagacttctcaatttattaatcccagtctttcgacagttagatttaataatgaagaaactggaattaaagcaggtcaaacaatcattgatttaattgaagggaatgttgttgataatttacagttaattggatataccttaattaagggacaaagtgtcaaagatttaaataaataaataaaagtgatgatgttttaataaaaaacatctttttttattaaaaatatggtatcggtttcagctttttgttaaaaagtattgacagggtcacaacaatcgcttatagtatatttgtggaaccgataccatagaggaggataaaacatggattataacaaaattgccaaagaaataattaattgtgttggtggtaaagaaaacattacgggggcaatgcattgtgcaactaggctacgtttaaatctagttgatgaaagcaaggttgatgaagaatcattaactgatattgatgttgtgaagggaacttttttagctaaagggcaatatcaaattattttaggaccaggtctagttaatttggtatgtgacgaagtaacaaatattttaggaattaaaactgacagtacgctccaagtagaaaaagtagaagaaaaaggaaacttattacaacgtgcagttcagttattaagtgatatttttgttccaattattcctgccatcgttgctggcggattgttaatgggaattaataatattttaacagctcaaggactattttttgctaataaaagtttgattgaagcatatccgcaatgggctgatttagcatcaatgattaatttattttcaaacgctgcatttacttttttaccagtgttaattggatttagtgctactaaaaagtttggtgggaatccatatttaggtgcagctttaggaatgatcatggttcatccggatctactaaatgcttattcgtatggtaaagcaggagtagaagtaccagtatggaatatttttggactatcaattgaagcagtagggtatcaaggaacggttttacctgtattaggggtatcttggatcttagctaacattgaaaaacgtttacacaaagtgacaccaacttggctggacaatcttacaacaccattattagcaacgttaattactggttttattacttttattttagttggcccattattaagagaagccggggtcttattatctgatggaatatcatggatgtataatacgctaggattattcggaggtgcaatctttggatttttctatgcaccaatttgtttaacaggaatgcatcatagttttattgcagttgaaacacaattattggcatcgatcaagacaacaggtggatcattcatttttccaactgcatcaatgtcaaatgttgctcaaggggcagcagttattgcaattttattagtaactaaagacaaaaaattaaaaagtatttgttcagcttcaggtatttcagcgttattaggaattactgagcctgcaatgtttggagtaactttaaaacttaaatatccatttattgcagctatggtaggttcagcagttggaagtgcttatttagcggcaacaaaaacacttgctaatgctttaggggcagcaggtataccaggtttcttatcaatcgatcctaagaattatttgaattttgcaattgggatggtcttaagtattgcagtgtcatttgttttaacaattatattatataaacgtgatatggctaaacaacctactcaagatagtgaactgccaactgaagctaaagaagtaaaaacaaacattatcactgcaccgctagctgggaaagtagcttcaataacggaagcaccagatgagatttttgcacaaaaaatgatgggtgatggggtagttatctttcctacagaaaatattttagcagctccgattgatggtgaaattacaatgatctttcctacaaagcatgctttaggaattaaaagtaatgatggaattgaaattcttattcatgtaggtttggatactgtaaaacttgaaggaaaaccatttaatttatttgttactgaaggtcaaaaagtaaaacaaggtgataaattaatggaaattgattttgcgatggttgaagcagcaggatgtccaattgcgacaccattagttattacaagtcaaaatcaatttgaaattattaatcttggaacatgtagtttaaatcaagatataatcaaattagactaggagaaatagttatgacctgtttaaataatgaacaaatcaaaaaattagaaaaacaagcaagtaatgatgaatatcgccttaattatcatttaatgccacctactggatggttaaatgatcctaatggattatgtcagtttgaagggatttatcatctttactatcaatatgcaccagacgattgctttggaggtgataaatattggggacattatagtacaaaggattttattacttttaaaaatgaacctgttgccctgtttcctgattgttctttagatgctggaggtgcttattctggctcaacaataatcaaggataataaaatgtatgtttactataccggtaacgtaaaatatcctgggaaacatgattatattcatactggtcgtgaccataatacaattatggttataagtgatgatggaattaattttggtgaaaaagtatgtctaatgaaaaatgacgattatccagatgacttgactttgcatgttcgagatccgcaaattattaaaaatggtgatcattattatatgattttaggagctagaacaaatcaagatgttggctgttgtttattatatcgaagtgatgatctggttaattacaaactagttaatcgcattatttctaatgaaccatttggctatatgtgggaatgccctaatctagttaaatttgatgagcagatgattttattttgctgtccgcaaggagtagaaacagcaggttatgattatgagaatctatatcagaacggttattatttaatcaacggtgatcttgaaaaagattatagattaagtgaatttattgaatttgatcatggctttgattattatgctccacaattatttattgatgagcaaggaagaactattattattggctggatggggatgcccgatgtcccttatacgaatccaacaaccaaatataattggcaacacgcttttacgcttccacgtgagctaacctttaaaaataataaagtatatcaattaccaataagtgaaactaaatcgttgagaaaagctaaagaaataattaatttgtctaatcatgaaaaaatatcttgtaaaggcaatatatatgagttatatttaccgataaataatcgtgattttactctaacattacgaaatgatgcagttattgattatcacaataatttgttgacattttcaatgggtgcaagtggttatggtcgtgattcacgacatatcgttattgatgatctatcaaatatgacgatttatagtgatacttcatcattagaaatatttttcaatgatggagaatatgcacttacaacacgtatatatgatcatagtagcaaccttgaaatatctattgacacagaaattcaatgtacttactatgagctaaatagttatcagatagtttaggtatctgaagaggtcgtgaccagattacgacttttttattttcttagtatgacatttgtcactttaaaattgtgatgaaagcagttactatataattacaaatgtaatgtataaagaaatagggggaatttatggaaatcaaaaataatcaaaaaacaattgttaaaatgatggtatttctttgcctctgtattacgttgatgatttttggattttatagttatccagattttaaagcaacagtaggacaacagcgttttggggcaacctatatgacgatgaataatccattttttgaagtgattaataatgagataaaaaaagcggttgaagcgaatggagatgtcttgattacacttgatccaattttagatgttgataagcagaatgaacaaatattagatttgattgaccagcgtgttgatgcgatttttgttaatccgattgatgctaaaaaaatagaaattggattaaaagcagcaaaaaaagctaagattccggttattgtagttgatgcccctatttatgatgagtcattagtaaattgttcaattgcttctaacaattatgatgcaggtgttttatgtgcaaaagatatgatgagtaaacgagatcatgctaagattattttattagagcatgctactgcaaagtctgcggtagaacgtattcagggatttcttgatactattgctagtaatgctaattatcaagttataaatcgtgctgactgtgatggtcaaattgagattgcaatgccaacgatgaaacagatgctaaaagaaactcctgctgtagatgttgttatggcattaaatgatcgtagtgctttaggagcattggcagcgattgaatcaatggaaatagataatgttttagtttatggagtcgatggttcgcctgatgttaaagaattgatcaatactggactgattcaggcaacagcagctcaatcacctgtcaaaatgggacagttagcttatcaaaaagcgaaagcgttattagaaaataagaagattgaaaagaaaatagaagtaccagtagagttgattagccgtgataatatttctaactttgagttaacggggtggcaatgatgcaatacagtgagtatcgctctgtatcgtcaattaaaaatatgatgatcataatcaattttattattattttatttgaagctagtattattttattttcaacaaaatatgtttgtaataatttgatggggcgcgattttttagatacattagcatatttaccaaagaatccgactaaagtatttatttattcaattataggatttgcattgttggtaatgattatgttcattagaaaatctgagaattttcaagttcgaaatggacgagtcatttgtaatggattagaaataattttatgtttctggattatttataatctttatatgggctataatggaatagctttattagtgtttgcagatataatttttaataccaaaaatgggcgcaatacaatggttattatcgggtttattttaattatttttttgttatctaactatgacattatttctaatataattccaatggtttctttagacagctatatacaggtttatgatgccgcgacgaaaactgcgattttaatagctaaaaatattcttgaatcaacaaacctagtcttgtttattatgtttttaattgtctatattgcaaatcaaattagagaaaatgagaacatttcaaaagaactttctatgatcaacgaagttaataaacaattgaaggattatgctgcggtgacagaaaaaattggcgagagtaatgaaagaaaacgactggcacgagaaattcatgatacactcggtcatgctttgacaggaattgcagctggaattgatgcatgtattgcaatgattgatatcgatcctaatgtaactaaacaacagcttttagttgtttctaaggttgtccgtgaggggattagtgatgtccggcggtcacttaataaattgcggcctggagctttagaagagcacacattaaaagaagcaattcaaaaaatgattaaagaatttagcgatgtttcagaggttgagattatgcttgattatcagttagataaagttgattttgaaaatactaaagaagatattatttttagaattgttcaagaaagtattacaaatgcattaagacatggacgagctaaaaaggttgaaatcaatatttaccaaagggtatctgatttagaaattgttattgcagataatggagttggctgcgatgatctaaaattaggttatgggttaaaacaaatgcaagaacgggctgctattttaaatggacgtttagaatactatagtaaagaaggttttacagttaaggttacaattccaatgaaagagggggaacgatatgattaaggtattaatcgctgatgatcaagaattaattagggaatcattgaaaattgttttaaatacacacgaagatttacaagtgatcgatacagtagaagatggttttggtgtattagacagtctaaaacgaaatattccagatgttattctaatggatattagaatgccaagaatggatggggtatattgcacaaagatggttaaagaagcctatccggatgttaaaataattattttgacaacatttgatgatgatgattttgtttttagtgcattaaaatttggagctagtggataccttttaaaaggagtatcaatggatggattgtatcaggctattttaactgttgtttctggaggtgcaatgatcaatccggatattgcgacaaaagtatttagacttttttcgaagatggcaaatactaattatgcaatcaatgttaatgatgataatgttagggaattaaataaaccagaatggaaagtaattcaacaagttggttttggtttatcaaataaggaaattgctcaaaaattatttttatctgaaggaaccgttcgaaattatttaagctctattttatcaaagctagaacttcgtgatcgtactcagttagctatctgggcagtccaaacaggtcaaacaacaaaggatcttgacgatgattaaaaagaataaaataatgattattgtcttagttttagttatgggaatcgggttaatatattaccacaatcaaaagaaagttctaacaatcggaatatttgcgggaagtaattgggatgttcctacgttcgattattatgaaatgattgataaaataattgtccgttttgaaaaagagcatcccaatgttgaagttcaatataaaagtggaattcttaaggaagattattctttatggttatcaaatcagttattaattggtgctgagcctgatttatacatgattttaaatgaagattttaattccctatcagcattaggcgcattaaaaaatttagactcgatcattactgatgatcaagattttaatagtgatgaattttatcaaagtacttatcaggcaggacagtatcaaggtaaacaatatgctttgccttatgaagtaaatcctactttaatgtttgtaaataaaactttgctacaacaagaaggaatcagtcttccaaaggacaattggtcgctagaagaattttataatgtctgtcgacaattgactaaagatagtaataatgacggaattatcgatcaatacggctgttataattatgaatggatcaacgctatttatgctagtggaatagagttatttaatgaaactggaacgacctgtgattttaataatcacgaagtaaaaagtgctattcaatttattgaaaaactgaatgctttaaatcgcggctttaatattacttccaatgatttcgatcaaggcaaagtagcttttgcaccaatgcagttttctcaatatcgaacatataagccttatccttatcgagtaagtaaatattctacatttgaatgggatgtgattgaaatgcctcaaagttctgagcaacatttaacacaattatcatctttaatgatggggatgtcgatgcgaactagtgctcctgagttagcttggcaactattaaaagaatttacttatagtcaagcttcacagcaggatatttatgaatatagtcaaggggtatctccattaaaagaggtgaccgaatctaaacaggttttgaaattgttagaggaagatacgcttggtgatagtaaaattgatatgcgggtattaagccaggtaatggagtatccaaccacaaatacgcgatttagaaaatatgaggcagcaatgaagattgctgataatcagattaatcaagcacttcaaaacaatctggatttagatacttcattaactgctttacaaaaagaaataactaattatttaaacgagtagcaagtatgactattcgttttttattatgacaaatgtcattaaaaaaatgacatttgtttatgaaaagaaatgacaatgctcagatgtattgaaaggggttacttgataagatatagatgtcaaaagaaagggaggctaaaaatgaaatatgtaatattagttagtcatgggaacttcgctgaagggttactagattctttaaaaatgcttacaggtaatcatgatgatgtaattgcaataggattaaaagatggaattacagctgatcagtttgctatagactttactgagatgatcactaaaattcctaaagaaagtgaaattattgttttagctgatatcataggtggttcacctttatcaactgcaatgaatgtattggcacaatcaggattgattgataaaacgacagtacttgggggaatgaatttaccattagctttaacaacaatattaatgaaagatgttttagatactgatgctttaattacaaatgtgacgagtgaggcaacaggtgcaattaaacaatttgttttagaaacaaatgatgaagatgatgatatttaggaggagaagattatgtcagtttcatttgtaagaattgatgatcggatgattcatggtcaaacttgtacgcgttgggctagagaatatccttgtgatggattaattgctgtaaatgataaagcagcaactaatgatgttttaaaagctgcctataaagcagcaagtggtaagaaaacatttgtttggacattagcagatttcgcaaaaaaatcacaaaaagttttagatagtgacacaaaatatttcttgattgctaaaaatccaattgatatgtgtacgattttagtagatcagggatttgatcctggtgttaaaactgttattgtaggaccttgtaatgatcgtgaaggggctactaaattaggtaataaccagtcaattactcaagcggaggctgatgcgtttgaacgtatccataaagctggttatacaataaaatttgctttattaccagacgtttcgattgggacatgggatgatttcaaaagtaaatttggttattaaaatataaatgtaaaggggatttttattatggaaataagttggattcaagccgccttacttggattatttgcttgcttatcaagtatgccaggtttagggggaacatcatttggtaactacacattaggtcgacctttagttggtggtttagtttgtggaattattttaggtgatattcaaactggaattttagtagggattgcaatgcaagtagtttatatcgctcttgttactccagggggaacagtttcggctgatgtacgggcagtaagttatatagggattccacttgctatgattgcaattaaaagctatggtctagatgctgcctcaagtgacggagctgcacttgcaacatcatttggaacaatggttggaactttaggaacagttttattctatggtactgcaacgattaatctagcatggcagcatattggctggcgggcagtagaaaatggagattataaaaaattatatatagtagatatggtattaccttggatttctcatattttatgttcatttattcctgcgatgatcatgtgtaaaatgggagctccgatggttgacttgataaaaacctatttaccaatggatggggttgcaatgaaaacattatttacagtcggttcattattaccatgtgtcggaattgcaatcttattaaaacaaatcgttactaaagcaattgattttattccatttttctttggttttactttagcagctgctttaggaattaacttagtttctgcaactgttgttgcgggaatgttcgcattgatcaattatcgaattaaaatgttgacacttggtaaagtcgcagttgctgtagttgatgatgacgaggaggatatataagatggaaaagaaattatcaaaaaagaccctaaccaaatcttttcataattggtattatgggaatttaacatgtttttctcaagaacatatgcaaacatttggctatttgtgttcaatgttaccaattgttgaagaattgtatgataaaaaagatgctcgggcaaaagccattaaaacgtatactgccttttttaacaccgaaccgcaagtaggttccgtgattgttggaatgacagcggggttagaggaggctcgtgctaatggtgctgaagatgtagatgatgaaacaataaatggattacgtgcaggattgatgggaccgttagcaggaataggagattctttagtagttggaacgataattcctattttattaggggttgcaatgggaatgtctacaggtggttcaccattaggggctattttctatattattgtttggaatttatttgcttattttggaatgaagttattatattttaaaggttatgaattgggtggtaaagctgtagattttctagttggacctcaaggagaagctttacgagaatcaattacaatgttaggtggtattgtgattggggcagtagcagctacatgggttagtgtaaaaacaagtttttcgatgactgctgctggagctaaagaaccgtttttagatttacaaaagacgttagatggtgtttatcctggatttttaactgctttattcgtgttattatgttggtatttattgtctaaaaagaaaatgtcaccaatcaaagtaatgttattattagtggttattgctcttattggagtattggttggattctttaacccgggattaacatattaaaaaggagaacttaaaatggatcaaagagtaaaaaaagcatattttgaagaaatagaatatcagactaaacaaattaatcgattaaaaatatggctaaaaaatttattaattatttcctctcttattatagctatcatattttttgtagataaaataagtatgattattactgtgatttcatacattgctttaataataatcataatttctttgattattattaacttggcgattcgtaatggttcaatgaatgtaaacaatattattattaaaatggaacatattaaataataaattaaacaagcccctaaaggagtatttatggtttagtaaaaaaaggggctctgatgattttaatagagcttatattagctggaaactaggaaattttaaaatttcctagtttttttcgaaacatttgtttttagtttgacacactattaaatcttgagtaacataagtacattggaggtgtactatgctgttaataaataaaacattaattagaatgtccgaaggaattagaggttggattgcaataattaccggacttaaaatattaacattagtaggaacagtaatgtttgctaaaactatttcatcctttttaagtgatttatatcatccgaaaatgtcacaagatcagttgctggcagcaataatcagtgcattgattgcttcatgtttgattttaatagctgatctattaactggagaagccgaatatcgctgtggggccaaagcacggattaatttgcgtaaagagatttttgaaaaaatgcttcaattagatgttggtaaaattgaaaggattggagcaagtaatacaattagtagtgttggcgatggagtggagctaatgcaggtttattacactaagtatttaccaagtttgctgtattgtttctttgcgccagtttatttattttttcagttaaaagatacttcgctgctagtagcgacaatactactgattatttcattaagtttaccgttagtaaataattattttagaaaaatgattgatcaattaaagaaagaatattggactagttttcaagatttaacaagttattatttagaaagcttaaaaagtttggttactttgaaattatttaatcaagatcgacgtagacatgataatttgaggcgaaaagcggatacatttaatcaaagtacaatgtcgattatgaaaatgaacttttcatcatttttggtttcagatggattaatttatttaggtgttattctggcagtagtaattggctgttcacaattggctaaaggaacgattgatttagcacaggcagttttattgttaatgttgtcatatagtttttttagttcaattagacaattgatgtctgcgacgcatgatgctttatcagggattgcggcaacaataaaagtagatgaaatattaaatttagatgcttcaagaattcataagagtgaggctgaaacagctcacgaaatagcggttaaatacagtcaggatactttagcttatttgcaggattattcggggatcatagtaaaagatattgtttttaattatcatcaaaggcgccaagttttaaagcagttaagtattgaaataccaaaaggtaaaacaactgcaattgtaggtaagagtggttgtggaaaaagtacgttggcaagtatgctaatgcgttttattgacccagatcaaggctatttatttcttgatggtcaaagttattttagtttaacgcctgaagaagttagaaaaaacattgttatggtaccacaacgggttagtatttttagtggttcattagaagaaaatttgaaactggctgcaccaaatgcttcaacaagtgaattattaaacgttttaaaacaagtgcatttatatcaatggttgcaaagtttgccagaaggcttatcgacagatttgggtgatagtggtgctaaattatctggcgggcagcgtcaaaagattggaatcgccagagctctattaagtggtgctccatatttaatttttgatgaagcaacttcaagtgttgatcgtgatagtgaagatgagatttggcaatgtattaatgagcttggtttaactagaacattaattattatttctcaccgcttatcgacaattcaacgtgctgataatatcattgtgttaaatcaaggaagattagttgaacaagggaatcatcaagcattattaaaatatcatggtgaatattatcagttggtaaaagaacaagaagctttagaagcagcgggaaaggtaggatagattatggaacataaaaaatcattattaaccttaaccaaacgattattgaaaattgctgccacattaaaaaaattctttgttatttctacaattgtcagtataattggaaatattgctcaaatggggctaatgggatttggagctgcttttattttgagtgttgccggaaagttaaaatatgccaatagcgtcacatattgtattttaatgattatgagtggaattttaattgttacttgtcgttatcttgaaggatatttttcacatgctggttcgtatgaattattagctaaaatgcgagttgacatgtttggaactttacgcaagttggcaccagggagtttgatcggacggaataatggcgatatcatggcaattgcaattgctgatatcgaaagtattgaatttttctttgcacatacgattgggccattatttaccgttattttacttccgttagtgactttgattattgcaggaagtattgatatgctctttgtctatgcactgttaccaatctatttaattattagtgttattattcctattttagccattaaactgggtcgtaatataggaattggttatcgtcaaaagttaggagaattaaaaatatttttattagatagtgtatatggattatcagaaattcaaatttttgattatggaaaacgtcgtaatgaagaattagaagctgttaatcgcaatataaatcgttcaattcatcaacttgcttatcaccgccaattagttgtttccacgccaacgtttttcatttatcttgctcgaattgctgtaattgcagtagcttcatatcttgctttaaaaggaaatattgatacaaccggaattattatcttatcatttttagtttcggcttcattttcatcgacgcaatcattaacgactgtagtttcaagtttacttgaaacttatgcggcggcacaacgctattttgatttggaagatatggttcccgtcgtaaatgaaattgttgagcctaaagaattgaaaaatatcgacaaaattgaatttattaatgtaagttttagctatcctgaaattaatagaaaaattattgaaaatatgaatcttaccattaattttaaagataaaattggtcttgttggagaaagtggaattggcaaatcaactttgattagattgttattacgtttttatgatgttacaagtggtcaaattttaattaatggtatagatatcaaagaatactctttgcaagatttacgtcaacgaattggaacacttgaacaagacacttttctttttaatgattctattgctgctaatattgctttaggaaaaccaaaggcgacaaaagaagaaatcgtaaaggctgctcaaatggcaggaattcatgaattgatcattagtttaccaggacaatacgatactatgatgggagaacttcagaatcgattgtcaggtggtgagaagcaaagaattggaattgcacgggttttattagttgatcctgattttttagtcatggatgaaccaacaagtagtttagatgttattaatgaaaaaggtttattgaagacattggctgaacaatttgaaaataagacatggttaattgtgtcacatcgaccttcttcattgacgggatgtgatcgggtgattaaattagaaaataaacaaatttatgaattaggaggaaaagcttaaggcttttctttttttatatgctaaaatatgttcaggaggaaataagtgtgaaagaaaatatgaaatatttaactaaccattatcagttaagagaatttactttaataagaatgttagaaattattaatcaaaataaaaatataactcctggaggaactgttttttatggggattcaattactgagtattgtgatctggacaagtattatcctgagatagagactaaatataattgtggaatagcggggattacttcaggaatgcttttaaatttcatcgacgaaggggttatcaaatatcaacctaaaaacgtggttttgatgattggaacaaatgatcttggtaatacggtcatggagagcccccgtgatattgctttaaatgttaaagaaacaatcgaaattattcattataattgtttggatactaaaatttatcttgtagcaccattaccatgtttagaaatgcttcatggttataaagcaacaaagcaaggattacgcagtaatgataccttaaagatggtctttaaagagtataaaaatattattccgtatgattatgttactttgattaatccttttatggcactttgcaataaaaagggccaaccagttgaaaattattatcttgatggtcttcacattaatgatgatggatatcgggcctatacaggggtaatcaaagaaaaactgatagattgaattagaaaatggggatagctaatagattgtttaattacaacaatgatgctagaatactactaatggttgatttggggaggaagatattatggatacaattatcatcgttataaaagatagtgatgattgtttaagattaaaggagtttttaagtagtgactatcatattgttatatgtagtgaacttgaaaatattattgataaccttaatgataatcgaatcgttgctattattatggacttagatgatgcgactgaagttaatgtcgcaaagtattctagttataaaaatattgataatattcaaatccctttaatcgtaggtgggaactttacgggaaatcttcttaatttattaaatttaggagttagtgaggtaattgttaagccttataatgaagcaattattaaattacgaatcaataatgcaattcgtcgggccgaagataatgaatatagaataatggctgattttgatactttaaccaagatctataaccgtactgctttttatcgcgaagctaaaaaattaattacgcaaaaccaagatattaattatgatcttgcttgttttgatattgatcgatttaagattattaatgatatttatggtagtagtgtcggtgatgaactattgatttatattgctaacacgggagttaagcggatgaagaaacttggcggattaattggacgtttaagtggggatttatttgcaatcgtagttcctcatcaagcgaatattgaagacctgttgcttcaacaaatgaatgaagacattggtaactttgatcttggaatcaaggttgtagtcagttttggttattataatattgatgatctatcattaccagtcaataatatgtgtgatcgggcaatgatggcgataaaaaaagtaaaagataaatacaataccagctatgcaacttatgatgatgaacttcgagatcaagttttagaagaacagagaattattgatgaaatggatcgtgcatttgaaaatgatgaatttattccttattatcaacccaaatttaatatggtaacgaggacatatattggttatgaggcattgatgcgttggcagagtccgactcgaggaatggtgttaccaagtacctttattccagtttttgaaaagaatggttttatttctaaagcagatcgggtaatttggcgtaaagtatgtcaagatatggttattgcccgccaaaaaggacatgtcttattacctgtatctgtaaatgtttctcgaattgaattatatgatccggaattaggaaatactatcttaaaacttttagcggaatatgagctgtcgattgagttatttcaattagaaattactgaaacggcatatatgcaggatagtaatcaaatgattgaggctgtagtaaagttaaaggaacttggcttcactattttaatggatgattttggtagtggtttttcatcgttgaatatcttaaaggaattgccgtttgatataattaaaattgatttggcgtttttggaacattttgataaaaataataaagctgaaaagattttaaaatcagtgattcaaatggcgaaacgccttaatatggaagtaattgctgaaggagtagaaaccaaacgccaagaagattttttagtagaactaggttgtaatcgtgctcaagggtatcgttttgctaaaccagctagtgcttcaaaaattgcttatatggttgaaaatggtgtcatcggagtaggtgatactaaagatgaggatagtgcaatagttaatattgatgatattttaacgactgtttatcagcaaggggaagtagattggtatcgacaggcactgttagaattaaatgctcaagttttcgaatatgattttaagcgtgataatatgattgtttttgatactccaacaaaggaaaatggttctaatttagctaagatggaaattcccaattatctttacaatgtaagtattggtagaatcgtacattcaaaagatgtaaaaagatatcagactgttttcaatggtaatcaggaatttaaggttatctatcgacgttttatgattaaccatggttctggttatacttgggttaaagatacaggaagaataatttatgatgaagataacaaaccaaaaatatgtattggtgtaagtcgtgttatttcagatgaaaagcttaatgaacaaatgatgaatgttttatcagtaatggagcagtcaactgattttgattcatcaatcaaccatattttggcagagatcggggaagattttttacttgatcggattacgttattactagaagaaggaaacaattatcgttctgtctatgcatggcaagatgagtcgattgagcttgagattagtgatactttcccaatagtgaggacagagcttcaagaaatagtcacatattttaaggagcatcaaataattgttgttaataaaaatgaaggtaatcaatttagtaaacaaattaataaaaatttctttgataatcaagtaaagacacttgttatcattagtctaaacgatgatattggtgaatttatcgggtgtattgtttttacaatgataaatgattatcgacaatggcgcgatgatgaactttgggcattacaagaattagtaaaggggataaatgtctatttaaataaagagaaaatttttaatcgtttagatagcatattattaacatataatcgtgttatggaaaaattgaatgatggaatattgatgtttacatatgagtctcagccccagctgctatttattaatgaagcataccgtaagatattaaatattgatgatataaatgttactaattttcttagtacgtactatcggagcgtcgatttggatgttcaaaagcaaattcatcaggcaattgaaaagtgtgttgaaactggggaagaacagacgctttatcatccacttaaaacttgtgaaaagcagattattaaggctaaaactatttataatctttcgccagttaaagaaaatggtaaattggtaattattagcattactacgaaacagtgcacttaagtgctattattttatacttgtgtataattgtatctaggaggtcataataatggcagaaatattgattattgaagacgaagttaaattgcgccaagaactggaagtatatttaaataataatggatatttgactaaagtaattgagtcttttgaaaatactttagaacaaatgaatcagtttgatggggatttaattttattggatattaatcttcccaatgtaaatggacagtttttatgcaaagaatatcgtaagaattcaagtaaaccaattattattgtaactagtcgcaacaatgagatggatgaattgatgtgtattaattatggtgctgatgattttgtcacgaaaccgtataatccattaattttattggcccgaatcgaagcggtcttaaaacgaacacagcctacaagtgatgttttgattagttatgaaaagataaaattagatgtatctaaaagtagtattattgataaaaataaagtgattgaattatcaaaaaatgagttaaaaatattttactttttattactgcaccgtgggaaaattaaatctcgagaagaattaatggcatatttatgggatagtgatatgtttgtggatgataatacattgactgttaatattaatcgcttacgtaaaaagttagaggatattggtttaaatgatgtaattcatactagacgtggtcaggggtatatcattttatgagattatttgattatttaaaagatgaaatcattacggttacagtaatgatttctgtgacttgtttggtaatgttgattttggcagtttttaattgtccaacttttttagtagtctacattccacttctgctcattagctcatttgtagtagtattaatgtatgatttttttcggcgtagaaatttttataataatttgataggaatcttagatcatcttgatgaaaagtatcttattactgaattgattggaaatcctcattttctagatggtaaaattatggttaactgtatttatgaaattgataaatcaatgaaagaacatttaaatgatgcaatttatcgacaaagtgaactcaaagagtatattgagatgtggtgtcatgaagtaaaaacacctgtagctacaagtcaaatgattattgaaaataatctaaatccagttaatgagagtattaaagaagaactcataaagatagataattatgttgaacaagtactcttttatgctcgaagtgagaatgttgaaaaagactatttaattaaagatgttaaacttagtgaattagttaattcagtaattaaacgtaataaaaaagatttaatcaataaacatgttaaaattgaattagagaatcttgaaatagatgttgctagtgataaaaaatggttagagttcattttaaatcagattattaataatgcaattaaatatgttgatgaaacaccaataattaaactatttgcaaaacaatataaagatcgtgttgaattaatgataaaagataatggaattggaatcttagaaaatgaattgaatcgtgtttttgataaaggatttacgggaacaacgggacgaactaaacaaaagagtacgggaattggtttatatttatgtaaaaaattatgttatcgattaaatcatgaaattaaaatagattcaaattcacatggtacggtagtaactttggtttttccgcacagctcacacataaccttacaataatgtaaggttatgttattttattcgatggtagaaattattatgacggctataatagttgttgaggtgaagagaaatggaaaaaattttaagaattgaaaaaattgaaaaatattatggaaataaaaacaacattacaaaggctgtcgataatattagtttcgatgttaacggtggtgagtttgtagccattatgggggctagtggtagtgggaaaagtactttactaaattgtatttcaacgattgataaagttactagtggtcatatttatttaaaggatgctgacattactaaactaaagggatataaattaacaaagtttagaagggattcgttaggctttatctttcaagattttaatcttttagatacattgacttcatttgaaaatattgctttggctttaacgattcaaaaatcagattataaaaaagtagatgagaaagtaaacaaggttgcagcagctttaggaatcaaagaaattttatcaaagtatccatatgaattatctggtggtcaaaaacaaagagttgcttgtgctagagctatcgttactaatcctgatttgattttagcggatgaaccaactggagctcttgatagtaaatcagcaagaatgttattagatagtttgaatgcgttaaatgaaaaattgaatgcaacaattttgatggttactcatgattcatttacagctagttatgctgatcgagtaatctttatcaaagatggtaaaatctttaacgaaattgttaaaggtgataattctcgtaaaatgttctttaatagtattatggatgttcaaacattattaggtggtgaactaaatgaagttatttagtttagcacttagaaatattaaaaagagtataaaagattactcaatttattttattacactagttattgctgttgctatattttatatctttaattcgattgatagtcaaacagcaatgatgtcaattagcaaatcaacaatggaaattgtgcagtctttagtaaatgttttatcatatatttcggtttttgtttcggtagttttaggatttttaattgtttatgcaaataatttcttaattaaacgccgaaaaaaagaaatcggtatttatatgactttaggaatgtcaaagttaaaagtatctacgattttagtacttgaaacagttattgttggagtgatttcattaggaatcggtttactcttaggaattggcttatctcaattgttatcaatttttactgcaaaattgtttgaagctgatatgaccaaatttacatttgttttttctagtggagcacttttatcagcgattattaattttggatttatttatattattgtaatgattttcaatattatcacactaaatcgatttaagttgattgatttattatatgcaaatcgcaaaaatgaaaaggttaaaataaaaaatggctggttaatttttattatctctattgttttgattgggtacgcatataagttattgtatgatggcgctttatatgttgtgggttctgattttttgatcatgattattctggggacgattggaactttcttgtttttcttatcagtatcaggttttttattaaaagttgttcaaatgcgcaaaaagacttattataatggtctgaatatgtttgtattaaaacaagtaaataataagattaatacacatgttatttctacaacagttatttccttaatgttattgttaacgatcgggatattatcatcgtctttagcgatggcctcagcaatgaacactacttatgagggaaatagcccaagtgatgttactgtattttctagtaatactgaaattattgatagatttaaacaggaaccggtgtatcaacaaatcatcaaagaggattatcagttcaattatcttaatttacaaggattaaaacaaggtatttttattgattcaaaagataatgcttatactaatatagaagcagtaaaaaatcaaccgatgcgggtaatcaaagaaagtgattttaataaaatcatggaattaaatggtaaagaagatcaaaaaatacaattggctaataatcaatatgaattagtagcaacttatcctgtagcacttgaatattataataagtttctagctggcgatagtacaatcaaaataggagatactacgcttcaaagtaatacggatcaagcagtagaattggcaattactaacgatagcggcaatgaagggtttgttgttgtaaatgaccagattgcaaataaatatgtggaagaacaagaaagttatttaacttatctagtggcagactatcaaggtgataaggaagaatgtgaggaacaattccaagatttgcttaaatcttttaatgaacagttaaggactgaaagcagtccaacagttattagttttacccggattggattagggcaatcgggaattggaacgagtgctttgtttacttttgttggactgtatttaggaattgtatttgcacttgcaagtggtactgtgttagcaattgaacaattatcagaatcttctgataataaagaacgttatcgtatcttaggacagttaggtgcaagtaaaccaatggtaaatagaagccttttagttcaaattggaatcacatttatgtttccattaatcgtagctttaattcatagttttgttgcactaaaagaaataaattatattattagtttgatggtcagcattaatatcgctgataacatcttggttacgacgatctttattgtaattgtatatggaggttattatttagcgacttatttagctagtaatcgaatcattaatgaataaaaaacccgttatgggttttttagtttaagagcgtatgcggaagttcgtagattatatcgtcatggctgtatgtacgaatttgtttatgaggtaaaatagactggcgatcttctaacaatccatcaaatacaatcttgtgtcgataggggagcagtgctaaattacagacctggggcaaagttgaattaggataaatttctttaagatgattaacaagcccataaatagcataaacaccagtttcattactaacgagcgtatagtcatcaagatttgttaaaattaaaaagtcatcaataaagccagctttaaaatcattaataatagtcagttcataattggttaggtgctcaggattttcactgatatagtggtcgattatatttggattatcaaatagtaaggttcgaatttgagaaaaatcatcttgctcaatataatcaagatttttcattgaaatatctgtaattttaaaaacttggttagtatactctaataaacttaaatacagctgataaaaggtagaactctcttgctcactgaaataagaatctttgttgattgtcaaatagtaatcatacggggataatccataaaaagcagcactatgaattaaaggaactgcagcacgtaaattcttttcaagatgttcaataacttgattatttgtaatttttaattcattaatcatataaatcaaatcgttaaggtcaccatgaatttgacaaaaaagcataatactatctctaaataattctcttacaaaaagattatcaatttgttcgactgcttcatagaggttagtgatggctggttcacttaagtcaaagccatatttagcgatcgttcttaattgtttggcggtataagccgcaggagttttttttactaatgtttggagctgttcaattttttggataatcggccgatatggctcataagctaataataattcagtttccccttgataaataaagtaatgctgaaatagatagtgatttgtatctaaatgagtgtttacttcattacgtgaaagtgaaggatcataactatgataaatatttactaattcttgtggttcaataatacctctaatggctagaataccaatcaataattcattgatttgatctatttgaatgaccttgtcaatatccgcttgttctacagcattaataacatttatctttatgtcttcagggatttctaaatagttattattattaggatttttaattagtaagcatttgttgatcaatgtattgattgtagggatatctttacgataacttttggttttttcaaaattttgtaagaaaacgatttcgtcataacataaaatatctaaaacattttgaatactgccattgtagtatgctacgatctcttgataaatctgttttgaggtaatttgatgcggtggtttaggggtggcaacaatcttaaaataacgctggtaaatatgctgacattcaggtgttgtaattaattcaactagtttcattaaaccacctccttatacttataggatactacaatttgctgggagtttaaaatgatatacaaagaatctttacaataaagataagctatgcttataataatcaggtgaggtgtaagatgaaaagaagagagccggtaattcatgatttaaataagtgttcatttcatgaaatagaagataattattatcagtgtttatttaatgaaaatcctcaacaagttattccaattaaaaatttaacgattgaggaatgtaaatttattaagattgattttaatatgatcgaattagttaatactcatataacagattgtatttttgaaaactgtgatttatcaaatttagaatttaataaggttagtatccatcgttgtcactttattaactgtaagatgacagggctaaattttattgactgttctttacaagatcttttatttgagggagtacaaggacgctatatgaatattagtcttggaaatattcgttgtgttgagtttaatgatagtacattagatgaaagtagttttatggaagtgaatgttaaaaatcttgtttttaaacaagttagttttattgctggagaggtatttaaaacaagcttaaaagggatggactttaagaccactaatattgagggaattagaatcgatgattatagtttaaaaggaatccatgttgatatgtatcaggcaatcgctttagctagtttattgggaatcatcgttgattgaattcaatgacaaaaaatgaaattaagggctatttaagcccatttttatatcaattaaaaaaaataatgacaaaatacaattctgtgatataatgatgaagttataagagaggttgagtaaatgaagataagaaatattgcgattattgcccatgtcgatcacggtaaaacaacacttgtagatcaattattaaaattatcgggtacatttagagataatgaacaaatagcagaacgtgcaatggatagtaatgccattgaacgtgagcgtggaattactatattggctaaaaatacagccatcaattataaggattatcgcatcaatattatggatactcctggtcatgccgatttcggtggtgaagttgaaagaatcatgaatatggttgatggggtattattagtggtcgatgcttatgagggaacaatgcctcaaacacgttttgttttaaagaaagcattagcagctaaagtaaaaccaatcgtagtaattaataaagtagatcgtccagtagtaagaattcaggaagtaatggatgaagtattagaattatttatggaattaggagctgatgatgatcagttagaattcccgactgtctatgcttcagcattacaaggaacttctagtttggaccctgatttatcaactcaagacccaagtatggactgtttgtttgatatgatcattgatgagattccagaaccattagttgatgaagaaggaccattacaattccagccggctttattagattataatgattatgtgggaagaatcggtgttggacgaattcaacgtggtaaaatacgagttaatgaaagcgtaacttgtgttcgtgctgatggttcacacagtcaatttagaatccaaaaattatttggttttattggcttgcatcgaattgaaattgaagaagcaggggctggagatattgtggcgattgctggtttagctgatatcggtgttggtgagactgtatgtactacgggaaaagaagaagctttaccattattaaaagtagatgaaccaactattcaaatggtttttggtactaatacttcgccatttgcaggtcaagatggaaaatttgtaacagctcgtcaaattgaagaacgtttatttaaagaaactaaccgtgatgtatctttaaagattgaaagaattcctaacagtgaagaatggatcgtttctggacggggagagttgcatttgtcgatattaattgaaaatatgcgtcgcgaaggatatgaacttcaagtttctaaaccaaaagtaattattaaagagattgacggtgtactttgtgaaccatatgaagaagttaatattgaagcacccgatgactgtattggtaatgttatagaatcattaggatatcgtcgaggtgtacttgaaaatatggttagtaatgaaggacaaacaagtgtcacatatacaattccttcaagagggatgattggttttatgacaaactttttaacaatgacaaaaggttatggaattatttctcattcattcttagaatatcgcccaatggaaggtgaatcagttggagaaagatcacttggtgttttagtttcgatagataatggtcaaactacagcctatgctttaggtggggttgaagatcgtggagttatgtttattggtcctggtgttgatgtttatgaagggatgatcgttggtgaacatagtcgtgacaatgatttagtagttaatgttacaaaaggtaaacaactaacaaatacccgttcttcatcaaaagactcaacagttgttttaaaaagacctcggacatttaacttagaagcttgcttagattatattaatgatgatgaattagttgaagtaacacctgaaaacattcgtttgagaaaacgttatttaacagaacaagcacgtaaacaacaaaaccgtttaaaacaaaataattcataaagcaggaaatttcgattttctgttttttcttttttattcaattttgttagacaaactttgtaggaattttctaaaaaaagataatatttttatcgttaattcttaaaaaatgatgattaacactataaaatttgcatatttggcttgaatatgatattattgattcaagaagaaacgggggaattatttaaagatgaaagcaatcgtagaagtacaatatcatgggaaaaacgtaacagcaactgatattgaaaaattggtaaaagaggacgttaaatcacagggagttaaaatttcaactgttgatacgttgcaaatatattatacaccagaaacttcatcagtttattacgttgcgactacaaaagatggtaaatctgtaaataacgaagaaccattagttattgagtagtcttaatataatatccaaaaatatatccaaagcaagaaacgataatttagattatcgttttttgttttattatcatcaaaggtttgtggtttatcgacaaaaaacatgctataattattttgttttgaaggagtgaaaaaaatgaaaaaaattacagctggtttattagcatttttaatgctaacaggatgttcaaatatagataacgatcaaacattgtttgtagctaataataaagaaaaatatgcgcttatggattatgaaggtgataagcagactgaatttatttatgataagtatgaagaagttggaagttctggttatattgtaattaaggataaaaagtatggatatcttcttcatgatggtgaagaagcaatcaaattaggaaaatatgataaactagaatcaattggaaatatgattgttggttatgataagaatgaaaaaattagtattttagatggtgaaggaaaagaattatacaaggaagataaaaagacagagatttctttattcgggttaccggttattcatcaaggtaaagaatatattgttttatataatgatggtgaggtattaaaaaagagtaaggagaagattataagtgcatatacagttgatagtgattatgcggttattaattttgaaaagacctcatctatttacaatttagttaatgaaaagcatattgaaggaatcaagattggtggcaataatcagttgatggatcatagtagtaaaaaaggttatttgctttataatcgtaaaactcatgagatcaatgcattggatttagaaggaaaaataatttttactacaacacttgaattagatgatttatattatgataattcaaaaaatattattggagtaaaaaatcaaactacatatttatttaacaaagatggtgaaacagtaacatcaaacagttactatcgtaactataaaaattatgttgtaaagaataaagaaatgatttacggaccacataaattcgttaatgatggtaaagaaatagaggtaaatgggattcagttagacccaatggcatcatttacaaagagtaagattttcccggtgtatgtgcgtgatgaaggttaccaatattatggttttgatggtaaggaagcaataaaggaatcttataagagtgctgaagcttttgatgaaaataatcttgctgtcgtttctaaaaaagaagataaatattatttaattaataataaaggcaaaaaagtatctgaacaatatgtacgaattatgtatttaggtgaaaaatattatgctggatatactactggcagtaagtatgaagtatttgatgtagaaggaaataaagtaattaatgactattttatggacgaagggacaacctttgtgtataatgatgtagtttatggtatcttcaacaagagtggaagcagttatatttatgatatgaatgaaaatgaagtggttttctcagttgaaggtgatttagaattcaatgaaaaagggtattttgtaacagttgatggtgatgcttattattcattgaaaggcgagaaaatttataagaggtaaagaaatggaatattatatttacatgcttatttcgttggcagtaatgttgacagcaatcaaattgattttttgtgagttagaaggtagaacggcacaaaagaaaagtattttaagctggtatactaaattaaatgaaccgtttaagtatactcgaacaaaaagtattatctttatgtgtgtgatatgctatgctattgcgtcagttcaggcgatgtttacaactgaatggtttgttgaaatgttaggatttatcgcagttggagttatttgtgatgggattagccagtatattggattttattacaataaaatccgttttaggaagaaaatcaatgaggctttattgatgaaatcagaaattgccaaagcgatgaatgaaacagctaatgcgctggtacagcaaagtttaccaacttattcaagccatgagattgccgcccgttattttaatgatgacactcatttagcgactatctcatttgatgggggagaatatgttgctgcttttgaacatttaccaccacttacatatgttgtagaagctcaatatgaaaaagctgaagaaaaattagctgatcgcaatgttaaagtaacaaaattaacaaatgaagggaaattaccatttaaagatgagcgaatcgatgtcattgttaatgaattatctaattatgataagtatgatttgtatcgggtcgtaaaaccaggtgggtatattattgttaatcaaatgggtagtgataattataaagaattgatcaatattttcttaccttttaagttacatggtcgttgggatcgtgaggctagttgtcagacattgagtgacattggtttggagattattgatagtgtggaagaacatgggtatgttcgttttgacacgctggcatcatttattcagttcatgaaaggaatcactaaagctgatattactcaagatcgttttatgaatttttatagtcatgtgttgaaacagatcaaagataagaaatattttgaattaacgactcatcgttttatggtagtggcaagaaaaaaagagttataagagtaaggttaaattgaaaaaaattttcaatttaacctttttttatggagaaaaattaattattacggaaaatgataattaaactgccagacaatttttttaggagagttttatctgcgctatgaacagaaggtgtttataacgttggcagggttgtctaagatcatattgagatatgtaagtctgtgactagaaaattattgctttttgtaacgatgttggttcacgtatcagaaataatatgtactgctgttatgaagtggatattaagctgtttagaatctcattgccggaggagtaatgggtaactgattatgggcaaacgcttaaaaaaatgtcgtaaattcatatttaaaattgtattaaaggattttttacagtattgatagaataaaaagagatggttttatgattgttaagaaaaaggctttaaatctaaaaagatttaggagctgataaggtaggtatacttccaatctcgacactaaaagaattgttaattagaatattatattattgaatttaatatacaacattaaattcatgaagtaacatggctaaacagtaattaaatcaaatatcaagcaaggttaagaaaagtatcacttgtcacaccgtatgatcaataaacaaaagatgcaagttatgtagctaatacaatgcggtaaaattatcaagatgagttatttagagattatttaaattagattgaagaaaatagttaataaagatgatgaggttatttttattcatccaataatgctggcaggagataataaaattaaagatctagtattttaaatcagatcattagtcgaaaaatggaagtttaacttccatttttgattctttattgtataattaaagtaatttaataacgcatatttaatggttgttgtacattaataaggaatcttgttagaagcaagagcggtcccgccgccgtaatgaggagttaagacgatagaccactggtgaaaactgggaaggtgttaagacgatgaatctaagccggaatacttgccattatcttaggatacactttacggacgatagagtagttctacataaacgtgatccttttgtgcgccattttttagaaagggtcttttattatgtcaaaatatttaaaaatttcattagtatttatcttggttttattgactggatgtggaacagtaacaaagggcaataatattgtgaaaaccaaaacagaatcaactgaacaacaatgggctaatgaggtgacagcaacaattgatgcagctggtaatgtaacagtcataagtgaaaatagtcagacagatagcgctacagatgctggtgatgagcataataagggaacaaatagttctgctttagattctaatcagacatctaatgatggtgctaatactgatgttggtaataaagataattctacaaataataagccagctgataatgataatcaaatgattaatgttagcatttcaattgattgtaaaacaattttaaataatatgaatgatctaaaagatggttatgaacaatttatcccaactaatggaatgattcttagtactgaacaatttaaagttaaaaaaaatacaaccgtaatagatgttttaaagaaagcaacaagtgaaaatgagataaaactggttactgtttcttcaggttttgggctctatgtaaaagggattggtcaaattgaagaaaaaatatgcggttcatcgagtggctggatgtataaagttaatggtaattttcctgaatatggtgcaagttcttatcgattaaaagatggtgataaaatagaatggcgttttacttgcaaacaaggggatgtttaaatgctcagtaaaattaatataataaaaaacaaattagtaatcaaaccttttaaaaatagtcatccagtagtattatttgcttattttctttcagttattactctaacaattattcaacaaaattattatttaatcattttgtcgatagttagtgcgataataattgattattattttaattacctaactttttttaaagatatgaaatatactgttgttttggtggttattataatgattacaaatcctttatttgtaacggaaggatttgatatttggtttcaaaatgactatgtcacgattactaaacaagctctattttatggattagtatttggcttgctgttatcatgcatgttattgtggtttcgcataatgaaaacatgcttaacagatagtcatattgtttatttatttggttcaatattacctaccttagggttagttatatcgatgtgtttgaatatgattagtaaattaaaaaatcaatatcaaaaaattagagaggctaatataaatatgcccagtcaaaataagttgggttactaccgaaatatgatagttgtattagttacatatgcttttgaatcatcgcttgatatgatgaattcaatgcaagctaggggttatggacaaggtaagcgaactagttttcatctgtatagttttagaaaagatgatgctttaaaattaatagtaataataggactatttatgataagtttattaggatttttaatccgctatcgtagtttttattattttccacttattcaagaatttagtttacagtggcaagatggtttatttatgctagtttatataggattaatgttattaccaatttatttaggaggaaagaaaaatgtataaagtaaaaaatgtatgttttacttatcctgataatgaaaaagtgattgataacctttcctttgaaataaataaaggggattttgttgttatttgtggcgagagtggttgtggcaaaacaacattgttgagattgttaaaatcaagtttacaaccgacaggaacacttgaaggaacaattgaactagacgaacaaataaaaaaagatattcagattggctttgtttttcaaaaccctgatgatcaaattgttatggataaggtttggcatgaaattgcttttggacttgaaaatcaggcaatccccttaaaacaaatgaaacgtcgagtaggtgaaattgttaattattttaatttacaaaatattattaacaatgatacacaatcattatctggcggagaaaaacaacttgttaatttagctagtgtaatggtaatgaatcctagtgttatcttacttgatgaagctacggctcagttagatccagttaatcgtgatgaatttattagaattttaaaacagctaaatgatgattttgatattacgattattttagttgaacatcaattagaaggcttgttggatgttgcaaatcgtttgattttgcttgatcatggccaaaaagttattgatgatcaaattgaaaaggcagtaaaaaagatgttaacagaggatgtttttgtagctgctttacctaattatgtacgagtttcaacattagctaatgcactttgtttaactgtaaaacaagcacgtgaagcactaaaagactatcatgattttgatattaaggagcaggaggttgtcgatactggacttttattgaaaattcgtgatttgagctttgcctacgatagtacggttttagaaaatcttgatttagatgttagacaaaatgagatattatcagtagtaggagctaacggtagtgggaaatcatcatttttgaaatgtatcgcagggttagttaagtatcaaggtaatataactaaagtaggagttgtagaaaaaattggttatttaccccaggatcccacaacattgtttataaccgataaagttataaatgaattattagtagtagaaaataatttaaaaacagttgaaattgaaatggagaatattggaattagtaatttacgagatatgcacccgtttgatttgagcggtggtcaaaagcaattattggcattaggaaaagttttactgacaagaccgcaattgttgttattagatgaacctactaaaggaatagatgcagtgagcaaagataatttggcgagtttgattcgtagtttaagcaaacatatgacgataattgttgttagtcatgatttagaatttgtcgctaaaataagtgatcgagttgctatgatttttaatggacaaatggaatcagtagactcgatgcgaaatttctttagtaataatttattttatactacaacgattaataaaatagtaagaaataataactctgaagttgttttattagaggatttagggttatgaaaataaaaaaaagtatctttattttaatggttattgttttaataacgatcttaggaactgttttatataaagatgaaaaatataatttaattattattgcttcgtttgcattatcttgtttaccattttattttaaatatgaaaatagcaaacctaaaataagggaagttgtggttttggcaacaatgattgccctaacagttgtttctagaacgatttttatgttaacacccagttttaaacctgtaactgcaatggttattatttgtgggatagtttttggtccggcatctggttttatgtgtgggtcgttgtcagcaacattatcagactttgtttttggaataggaccatggactccattccaaatgatcgcatggggaataattggttatggagctggaatttttagtaaaaatttgtttaaaaataaatttttattatatggatatagtgctatttgtggacttgctttttccatggtaatggatttatggtcagttcttgcttttgaaacaagttttaatttaacacgatatttggcaatagtattaacttcattaccaacgacgttaatatatattgtttcaaatataatttttatgtttttacttagtaagacgatgtttcagatcttacaaagggtaaaaataaaatatggaataacggagggaaaaattgaatgaaaaaattaatgcggtttactgtggcgttagcgcttgtttgtgcttgcattgtgccaatcaatgcgcaatcttcaactttagccaaagctcaaagctattggttgaataacaatgaattatctggactggatgccgttttggctgtagaatctttaggattagatgttgaagatgaaaagaataattttactttaaactattcttttgaagcaccaacaaattcttatggtgatgaaattacttatgaagaaatggatgctggttatttggctaaaaatattatggctttagcggcaataaaatcagatcctgctaagttaaaactaaaagatggttcaacgattaatctaattgatttattaaaatcaaaaattgatgaaaatggtaatgttgattatgggtcagcaaatccagaatcaagtactgcatatacaatgtttgccttagctattgttgatgaaaattataatcttgataaactaggattaaacttgactgagatgcagcttagtgatggctcttggggctataatggagcttggggtggacctgatattactggatgggcattagctgctctttcattatgcaacaatacatatcaggcttcaattgataaagctttagcttatttagcatcaattcaaattgataatggcggttataatagtggctttggcgttaattgtaatagtcaagcttgtgccgtatggggaattttagaatacgatattcaaggtgtaaaaaatggtacttacaataagggtacaggcaatccatatgatctattattacaatttatgcaagaagatggttcatttggcgctagtttagatgtagattatggcaatgcttatgcaacagttcaagcggcccttactgttggggtatatgaaaatggttccttaattgacaatattaaagctcaatatgatgagatgttgaatcctaaaaatgatcagccagaaccaacaccagctcctgctccggttacaccatctacacctgctgataagtcaattacatcagttaagacaggtgatgatgcagtcattgcactaacagtatcttcattgattattagtggtggaatgtatttgtttattagaaaagaatcttaaaaaagtgtaaaatgtagtgacccccaaaatgatatgtaccctccttactggtttgtccagtaaagaaggtacacatcaaaaaggaggtcactttttatacggaatagtaaaaaatttaaattaaaatatatttaaaaatataaggatgggaatatctaaaagatctatcgggtgtatgtcataaggatttttgactcaacgagtggaataaaattagaacatataagctgactttatccatcgaacaaaaaatggaactgataaatagagttggaaacagagaaaattatcggttagtagctttagctgccagtataggacgatgtattaataaaaaactgaacatcttagtttgcaattattattcaaaccttaaaggattaatctttcatttagatcaagaatgacattgtcacagcataaagcctatcaaaaatggttaagtgataaagaaaattgcatgaacaattcaaagctgcaatgagtgaatatatcgaatattataataacgagagaatcaatacaaaaagaaaaggattgagtccacttgtatatagacaacaatcctttcaagatctaactttaatttaacgtgtccaacttttcggggcactacaaaagcacttttttatttattatatttttggtggtttttacgatattgtaaaggagaaaaatttgtactttttttaaatgcttgagcaaaatatgaaagcgaggagaaaccaagaattgttgaaatctgtgaaattgataggtcggtatctctaagtaaatatttgctctcatatattcttcgctgaagtagatagctgattggtgaaacaccgacatcatttttaaattcatgagcaagatagaatttattcatatgagttttttcagctaaagtatccaaagttatttctttatggtaattacgatcaatgtagttcttgatcataaagatttccttgcgaatagtcttaccttgtgttaaagatacattaatacgatttaatcttaaaatatttattagtaagacttgcattagttgttggcacatatcatcatatagttcattcttagcttgtgattcttttaccattaaatttaagtaaaaaagaatctcatttttataattagcataattacagctaatataatcttttaaactatcctcaggtatttcaaaactaatcccatcaatagcaattacaatatattccaatggatttcgatcacgagaaacttcagtatgcatcgtgttagggttgataataacaaaatcattttcttgaacattaaattcgtctgctccgattttaaagccaccgcatcctttagttacataaaataattcagtaaagtgatgggagtgtaactgagaatgccagtcaccttcatattttgaactactaacatatagtaagcgagcttgattattaattaatgccggcttttcgataaattcaattctttcattgctcataattttcacctcgagtttattataactaatataacgtcaaatttatataaatttttatatttttataataaaataaagcaagatatataaaaaagtaagcaattatcgcgtagtaaaagcgcttacattaaaatataatttagttgtaattaatcataataaacaaggaggaaaacgaatattatgaagaaaattttaagtactgcccttgtattatcgttagcagcagggatgctgactggttgtggtggcgggaaatcagatgacaccaatactttaaaaatttcgggactaaatggtggttatgggacaaaaggatgggaagctgtagttaaggcttttgaaaaaaaagaaggggttaaagttgaattaaatttagaaaaaaatattgctgaaactttaagaccggtaattacttcaggaaaagatgtacctgatttgatttatttatcagtaggatctgaaggtggtttagtagatacaatgatttctgataaagcaatcgctgaaatcagtgatgttttagatatgaaagtttatggtgaagatgtaaaagttaaagataaaattatccctggatttactaattcatttgcaactaagccatatggtgatggaaaattatatttagcaccatttacttatgatccttgcggcttattctataatgctggtttatttgaacaaaaaggttggacagttccaacaacttgggatgagatgtgggaattaggtgaaaaagcaaaggcagaaggaattgctttattcacttatccaacaactggatattttgatgcttttttctcagcgttattaaacgaaactgtaggtgctgacgcttatactaagttaatggaatatgatactaaaacatggcaatctgctgaaactaaaaaagcatttgaaatagtcggaaaattagcacaatatactgaagctaatacggttgcaaatgctaataaagataattttacaaaaaatcaacaattaattttagataataaagcattattctgtccaaatggtacttggttgccagatgaaatgtctgaagcaccacgtgctgaaggtttcaaatggggatttatggcattaccaaaagtaagtgcagaaggagattcatattcttctacattctctgaacaagtatatattccttcaaaagccaaaaatgctgatttggctaaaaaatttattacatttatgtacagtgacgaagctgcaaaattatttgctgaagaatctggatgcgttttaccaactacaactgcttcatcatatttaccagaaaaagtaaaagataaagatggtaatgaaattgataatcaaaaaacactattctaccaaatttatgataatggggctaagagttgtacggttggatttaaatctgttgatgcaattgaaggggttgatctaactagtgctgaaggtattctttatggaacagttaattctgttgtaacaggagataaaacagttgatgaatggtataatgctgtgattgatgctgttaaaaaatacgacaaataataattgataaaataatagcggtggtgtcattccaccgctattttagaaagtaggtgcagcaatgaataagaaaaaagaaagacgcagattcattattttatgccttgccccagcggtaatcttatttggagtgttcatgattttgccgacccttaatgtcttttggatgtcaacattaaaatggggcgggctatcagccgataagacttttgttggatttaataattttgtgttattaatgcaagatatgaattttattcgtgctttacaaaataccattttgattattgcggttgtaactgtaattacgatggctgtagcaattctttttgcttcgattttagttagagaaaaaataaaaggacaaaatttctttcgggtaattttttatattcctaatatattatcagtagtcgttatctcttcgattttttctgcaatctatgatccctcagaaaatggtatgatcaatagtgttttaatgttatttaaaccagaaagctgggaaactgttaagtttcttggagatcaaagtattgttatttatgccatcataggaacaatgatatggcaagctataggttattatatggttatgtacatggcttcgatgagttcgattcccgaacacttgtatgaagcttcagcacttgatggagctgggaaaatcaaacaatttttttcaattacactacctttgatttgggataatatccgaacaactttaactttctttattatttcgacgattaacttaagttttttatttgttaaagttatgactagtggtggacctgatggagctagtgaaacggtcttaagttatttatataaacaagcttataacaacgcatcatatggatatggaatggcgattgccgcagtagtttttattttttcatttattttgagttttattattaatcgtgctacagagcgtgatacgttagagttatagaaaggagcaggaaaatgaaaaagttatttagcagtgataaactttataaaatatttatttatgtagctttgattactcttgcggtttctattattgtaccggtagcatgggtatttatggcttcaatcaaagagaattctgagttttatggaaatccctggtctattccggcaggaatctatttgcaaaactttgttaatgcatttgaacaagcgaatatgggagaatatttacttaattctattttaacaacagcgatggcactggtgattttattagtcgtttcattaccagcggcgtatgtattggcgcgttataattttaagggaagaagattttttaacaccttatttatggcagggttatttattaatgtaaattatattgttgtacctatctttttaatgttattagattgggatgattttatttatgaattactcggaggaaatttctttttaaataatatttttgttttagctgttgtatacgcagcgacagctattccgtttactgtttatttattaagtggttattttaagactttaccaaaggcttatgaagaagcagcgttaatagatggatgtggatattataaaacaatggttagagtaatgattcccatggcaaaaccaagtattattactgtaattttatttaattttttagcattttggaatgaatatattattgccttgacattattaccaagtacttcaaaaacattacctgtaggattgttgaatttgatgcaggcaacccgggggaaggctgagtatggtatgatgtatgctggattagtagtagttatgctgccaacgttgattctatatattatagttcaaaagaaacttacacaaggaatgaccttgggtggattgaaagattagaggagaaaactatggatggaaaaactaaaataattatcatggttgttgtatttatagtttcaatggctttgatttttattggacaaaaaaatgttggttatacaggattagcgactgaactggtgggcttagctggattgatcggagtaatttacacatataataaaggctataagtaaaggagaaacaagatggcgaatttaagcttaaaacatattgataagatatatgataataatgttcaagctgtatttgattttaatctagaaatcgcagataaggaatttattgtttttgttggtccttctggttgtgggaagagtactacacttagaatgattgcgggattagaagaaatttcagcaggagagctatatatagatggaaaattgatgaatgatgtggctccaaaaaatcgagatattgcaatggtgtttcaatcatatgcattatatcctcatatgagtgtatatgataacatggcttttggtttaaaaatagcaaaaaagccaaaagatgaaattgatcaaaaggttcgtaaagcagctaaagctttagatatagaacaatatttagatcgtaagcctaaagctttatccggtggacaaagacaacgggtagcattagggcgagcaatcgttcgagaaccaaaagtatttttaatggatgagccattgagtaatttagatgctaaattaagagttcagatgcgaacagagatttcaaaattatatcagcaattaggaacaacatttatttatgtgactcacgatcaaactgaagcgatgacgatgggaacaagaattgttgtgatgaaagatggtcggattcaacaagtagcatcaccagcatatttatacaatcatcccgtcaataaatttgttgctggttttattgggagtccacaaatgaattttttaaatggtaaaattaatgaaaaggacggtgctattattattgaactgagtgatgttagtttaaaggttgaatcaactagagctaagcagcttagagaaaaaggatatttaggcaagacggtaataatgggaataaggccggaagatatcagtgttgataatgactacattaatgagcatcaggagtattgttttgaggggaaagcagaagtagttgaatttatgggttctgaaagttatatccatatggttaaagatgaaaaaccgtttattgttaaagcccctggcggaacaactctgacaaatggggtaattgggagatttgcttataagatggacaaaatgcatttctttgacatagacagtgaagaagctataattgaaggagagtagacatggaaaaatacgggagattaacgttacctactgatttagatgtaattgaccaaacgattgaattaaaaaataaacttggggctgatgcaattcgagattgtgatgggaccgacatgcctcaagaattaatgaatttggatgctaaaatatatgcaacatattatactacaagaaaagataatgagtgggctgaagctaatccagacgagatccaacaagaatatttgataacggaccgttatactgctcgtgatactagtttaacgattgagttaatgaaaggttttcatactcagcagctgaaagttaatgatattgatgatcctaaacgctggtgggaagtaattgatcgtactactggtgaagtagtagcagttgatcaatgggaatttaataaagaagttggagcagtaacaatttcgactataccttatcatgaatatacagttagttttttggcatttttaatttgggatcctgttcatatgtataattttattacaaatgattggaaagatgcgccgcatcaattaacctttgatgtccgtcaacctaagaccaaggaatttgttaaagataaattacggaaattttgtgaagaaaataaacatgttgatgtaattcgtttcaccactttttttcatcaatttactttaacatttgatgatcaaaaaagagaaaaatttgtagaatggtttggatatagtgcaagcgttagtccttacattttagagcaatttgaaaaatgggcaggttataaatggcgcgctgaatatattgttgatcaaggatatcataattcattatttagagtaccatcaaaacaatttaaagattttattgagttccaacaaattgaggtttgtaaattagctaaggaattagttgatattgttcatggttatggtaaagaggctatgatgtttttgggtgatcattggattggaacagaaccgtatggtaaatattttgaaacaattggtttggatgctgtagttggttctgtaggaaatggtgtaacgatgcgaatgatttccgatattaaaggcgtacgttatacagaagggcgttttttaccatatttcttccctgatgttttctgtgagggtggtgatccgattaaagaagcaaaagataactggttacaagcaagaagagctattttaagaagtccgctagatcgaatcggttatggaggatatttgaaattggcagtggaatggccgggatttgttgatacaattacccaagtagttgatgaatttagacaaattcatgatttaacaaaagaaacaaaagcctatacctctccatttaaagtggcaatactaaactgttggggaagtattcgacgttggatgaataatcaggttcatcatgctatctggtatcgtgaaatttattcttatgtagggataattgaatgtttaagcgggatgccgatcgatgttgagtttattaattttgatgatataaaaaaaggaattaatcctgatattaaagtaattattaatgccggtacggcttacacatcatggtcaggagcagaaaactggattgatgaagaggttcttacaaccattagaaaatggatagataatggtggcggttttatcggggttggagaaccaaccgcttatcaatatcagggaaaattctttcaattaagtgatgttcttggtgttgataaggaagttggctttacattaagtcatgataaatacaatacagttgatcctaatcattttattgttgaagatattgaaggagaaattgattttggtgaaggaatggctagcatttatggacatggtgaaaactatcaaattattcgtcaacataaagagtttgctcaattagttacaaatacttacggtgctgggcgtagtgtttatttagctggacttccttattcaccgcaaaattgtcgtttattattaagagcaatctattgggcggcagctaaagaagatgaaatgaaaaaatactatgtagataatgtcaatgctgaagtagctgcttttgaagcggtaggaaagatcgtagttattaataactcactagatgctctggatacctatctatatgtagaaggaaatttacgaaaaaaattaagattagcaccaatggaaatgcgttggcttgatatttaattgaaagactcattttctttgaaagtgggtcttttaaaaggaggataaaaatgaataaaccagtattagtaattatggcagcaggtatggggagtcgttatggcggattaaagcagattgatccaattgatgaggatggtcatataattattgatttttcgatttatgatgctcgacgagcaggttttgaaactgttatatttattataaaaaaggaaaacgaagaagagtttaaagaagttattggagatagaatggagcaaatcatgaatgttaaatacgtatatcaggatttggctaatattccagcggaattttcattaccagctggtcgtgtgaaaccatggggaactgctcatgcgatttggagttgtaaagatttaatagatgggccatttgcagtgattaatgctgatgattattacggagttacagcgtataaacaaatctatgattttctattaaatcatcccgatggggtaaaatataattatgcaatggtaggttattatattgaaaatacattaactgaaaatggtcatgtggctcggggtgtttgtcaggtaaatgataaacaactgctggttgatattcatgaaagaacacaaattgttcgaaatggtgcaggtgcaaagtatactgaggatgatggtcaaagttgggttgaactgcctaaaggaacaattgtttcaatgaatctttggggatataataagagtatcttattagagatagaaaaaggaataaatagtttttttgaaatcggtttaaaagaaaatccgttaaagtgtgagtattttattcctgcagttgtaagtaaattacttgatcaaaataaggtagaagttacggttctagagtctcaagaacgctggtacggtgtcacttatcgtgaggataaaccaataattcaaatggcgattaaagaattaaaagatgcaggtgtttatcctaagcatctttggaaggagtgatcaatagtgagtgaagagttattaaacgaagtagttgaagcattttcatttgaaggtgtgttgaagaaaaaaaagccttatggaagcggacatatcaatgatacatttttattgacttttgatattgaaagaatgggaatgattgatatcattttgcaacgaatgaatactgcggtttttactaaaccgattgaattgatggaaaatattgctaacgtaacaagatttttacgagataaaattattgctagtgagggtgatcccgaaagagaaacactcaatattatttatactttggatcataaaccatattatgtagattcagctggtggatattggcgagcatacaaatttattacttgtacaactagttatgatcaagttgagagtgctgaagatttttatcaaagtgcattagcttttggacacttccagagccttttggctgattatccggcagcaacacttcatgagacaatcaaaggttttcatgatactaaagctcgctttgaacgttttaaagaagtagttgccaatgatatttgtaatcgtgctaaagatgttcaaacagagattgaatttgttttagctcgtgaagatgtggcaaatgtattaacaaattgtaatttgccaatacgggtcactcataatgatacgaagttaaataatgttatgattgatgataaaactcataaaggtatttgtgtgattgatttagatactgttatgccgggtttagcagtcaatgactttggtgattcgattcgatttggagccagtacaggggcagaagatgaaattgatttagataaaatcgaatgtgatatggcgttgtttgaaatttatgctaaaggttttatcaaaggttgtgatggtaaattaacgaaagaggaaatcaaagcattaccgattggggctaaggttatgacatttgaatgtgggatgcgttttttaactgattatttggagggtgatatttatttcaaaattcatcgcaagaatcataatcttgatcgttgtagaactcaatttaagcttgttaaagatatggaatcaaaatgggaaatgatgaataaaatcgttgaaaaatatatgtgattatattaaagaaggtaaatttttagcaatatatgggaataatttgtaagcgctaaattttatgtaaaaagttctttaaaaccaaggggttaggtgttataattgatttatagaaattttaaggaggagtcataaaatggcagaaaaattatctttcgtagtatctgatcctgtaggattacatgcaagaccagctactatcttagttaaccaagctagtaagtttacaagcaatattaaattagtatacaatggtaaagaagtaaacttaaaatcaatcatgggagttatgtctttaggtgttcctactaaagctacagtagaaatcgtagctgaaggtgatgacgaaaaagatgtaattgcttcaattgcaaaagttattaaagaacaaaaagtagctgaataagaaaattagaagtcctcggacttcttttaattacctgttcaaattgaaaatttgaacatatagacttaagtcagttgagcatacgaagtatgcgaaataaaaaaccacctgctatgcgggtggagcaataaagaagttatacaaagatatcacctttccgatataatggagttgttcaagctgtcattataagaaaggaaaggtgattaagtatggcacaaaaaacaaattcattggcacatacgaagtggatgtgtaaatatcacatcgtcttcacaccaaagtatagacgaaaagtgatatataatcaacttagaaatgatataagagaaataataataagattatgtcaatatagaggggtggaaattatagaggggcatttgatgtcagatcatgtacacatgttggtaatgataccagcaaagttaagtgtatcatcatttatggggtatttgaaaggtaagtcagcattaatgatatttgatcgacatgcaaatttgaaatataaatatggaaatagacatttttggtcagaaggatattatgtgagtacagtaggactaaatgatcaaacagtcgcaaaatatataagggaacaagagggacatgatatagcaatggataaattgagtgtaaaagaatatcaaaatccatttgaagataaagaaatgaagaaagaaaacaaaaaagagagaagaagataacaaaaggagaaaggaggaaataaatccctttgagggatggcgagagtcaaaagcgatagcttgaacgaagagaaagcagcgccttgagacgcgagcaagcaacataggcttatagcctcagagaaaaccacgtcttttaggcgtggtttttatttgcttaaaatttatgtttggattaagataataatgttgttaggaggtttttatggctaaaaaaattaaaactaatgctttacgtttattagatcaagcaaagattgattacgaaataaaggaatatgaatatgatgaagatcatttaagtggtgaacatattgttgcacaagttgaaataccggctaaagatatttttaagacactggttttaaaaggaaaccgtggttttttagtatgctgtataccggtattagaggaaatagatttaaaaaaattggcaaagttatctaataataaaagtgtagcaatgattcatatgaaggatttattagcaacgaccggatatattcgtggaggctgtagtccagtgggaatgaagaaaaaatttgatacttattttgattgctcaattaatgagtgtgataaaattgctctcagtgctggaaaaagaggatatcaaatgattgtagaagcaaagcagttactagcatatttagatgcggtagttggtgatgtgataaggagatagcgatgattcaatgttattatggtaatggtaaaggaaaaactactgctgcagtaggacaagcattaagaatggctggggcagataaaaaagtattatttctacaatttttgaaagacggtgacagcagtgaaataaagatgctgaaaaagtgtggaattaaagtgttgtatgctaaaatgcctcagatgtttattgatatgcatgatccagagatgataaaattggtgagtcgtttagaagatgagttatttgaacaaatagatgaaagttatgaaggaattgttttagatgaaattcttgatgcaattgctttaaatttattaaatgaagggaaagtgtatgattgcttggtaagcttaaaagaaactcacgaggtaattttaacagggcgtcagcctagtcataaattaaaaccgattctagattattcgagtgaaattaagaaacataagcatccatatgataaaggaataaaagcgcgtaaaggaattgagttctaatttgtagtaatttcatttataaaacaagtagttatttttttacaggtttgttataattaaattaagaggtgaaaaacatgaactacaatgaagaatatcaaagatgggtaaattgtgaaaatttagatccatcactaaaagcagagttagcaagcatgaatgaaaaggaaaaagaggatgcattctatatgaacctagagtttggaactgcaggaatgcgaggaattttaggggctggtactaaccgaatgaacatctatacaattagaaaggctaatgttggctttgctaaatatgtattaggtttaccagaaggaaaagaacgtggagtcgcaattggttatgataaccgccacatgtcttacaaatttgcaattgaaagtgcgaaagttttagctacttatggaattaaatcttatatttttgaaagtttaagaccaactccagaattatcttatgcagtacgttatttaaaatgtgctggtgggattatgatcactgcaagtcataaccctaaagaatacaacggttataaagtatatgatgatactggatgccaattaattcctgaatggggagatcaagtagttgcatatgtaaatgaagttaaagatgaattggcagtagaagtaattagcgatgaagaagcttatccatatattacatggatcggtgaagaagtagatgaagcatattatcaagaagtaatggcaattgaaattaatcccggtatggataaaaaagatttcaaaattgttttctcaccacaacacggtacttcaaatctaccagttagaaattgtttgagtcgtttaggctataatgttattccggttttagctcagtgtgcaccagatcctgatttttcaaatactaaatcaccaaatcctgaagttgactgctcatatgatctagcaattaaaaaagctaaagaagttgatgcagatgtcgttgtaatttgcgatcctgatggtgatagattaggtgttgttgctaaacatgatggtgaatatgtattgatgtctggaaatcaaagtgctgcagtatatttagaatatattttaagcgaacttaaaaagcaaggtaaattaccagctaatgcagtaatgtataatacgatcgttactagtgatttaggtgaattggtgtctaaatcttatggtgttgaggttgaaaaaacattgacaggatttaaatttatcggtgataagattcgtaaatatgaaaaaacaaaagaaaaagaatttatcttcggatatgaagaatcttatggttgtgtagttaaggatttcgttcgtgataaagatgcagttcaagcggttgtaatggcagcagaagctggtaatttctataaacatcaaggaaaagatctaattgatgttttaaatgaattatatgctaaacatggtacgtttaaagaatcgcaaattgctttaagcaaagccggagctgaaggtgcaaaacgtattaaagaaattatggataatttaagaaaagatgctccaagtgtgattggaggatataaagtattagcagtagaagattatcaaagtagtcaacgtattgaaaatgaaactacgacagttattgatctacctaaatcaaatgtattaaaatactatttggaagatggatcatggattgcggctcgtcctagtggaacagaaccaaaatgtaaattctatttttcaataaaaggtaatgatgctgatgatgcgagtgtaaaaacagaagttttccaaaaagatatattaagtattattggtgaatagattataaaaagatggactttagagagtttatgctctaatttgagtaaaaactctttagctccatcttttttatttaaaatcagtaaaaaacagtaaaaaaaattattattttactgttttgcttttatttattagtataattttaataagatttaatcattttagttaaaatataataaaattaagtaaaaaataagtaaaataatcagtaaaaatatttacattattttattataattatataatataaatagatataaaaacatcgatgaacaaatatctaaaaataaatatatgaggagaacgaaaatgtatcaaagacttatggatattatgtctgaaagattattgcctattgcaactaaaattggttcacaaaaacatttagtcgcattacgtgattcatttattgcaacgatgcctgtggttatgacgggatcgatcgcattattgttaaatgctttttttgtagattttcctgctgaatttgggtggacaggaatcactgacgcatttcaatggttgattagtattaataatttgatttttaatgggagtttagcaattgtttccttagtctttatttttgctttaggatataatatcgctaaagtatacgaaacagataaattatctggaggattagttgctttatcatcatttgttatttctttaggaacaagtattacgcaaacatttcaattagagggtgttagtgctgatattgggaaaattattaatcaggtcactggcttgaattttagtgatggaaatttatcagtaacgatcaatggcttattaccaggaaaccaaattaattcacgtggttattttacagcaattgttattggttttttagcggtagtgatttatagtaaattcatgaagaaaaactggacgattaaattacctgattctgtacctccggcaatctcggtgccatttacttcaattattccggcttttattgctatgtatgctgtagcagcaattacttatggatttaatttggtgacaggtcaattaattattgattggatctatgatattttacaaacaccattgttgggcttctctcaaaatccgctttctattattttagtagcttttttaactcaattattttggttttttggaatccacggtgggaatgttatggcaccgatcatggaaggtgtttttggtgttgcattattggcgaatcttgaagctttccaaaaaggaacagaaataccatatttatggacgagtgtatcatatggtgcctttgtctggtatgcaacattaggcctgttaattgcaattttttggcaatctaaaaataaacattatcgtgaagtagctaaattaggtatagctccagtaatgtttaatattggtgaacctgttatgtatgggctgccaactgtcttgaatccgttaatgttcattcctttcctgttggcaccaattgtattgtcagcagttgcttatggggcaacagcattaggattagttgcaccagttacacaaaatgttacttgggtcatgccgccggttctttatggattctttgcaactggttttgattggcgagcaattattttatcacttgtaaatctggctttagctgtaattatttatttaccgtttgttaagttggcaaacaatcctaaatttgaagaaaaataagtggaagaggtaaataatattgggtagtattgaagtaaataaagagtttttcatcaatggaaataaagttaagattatttctggagcagtgcattattttcgaattgtacctgagtattggcgcgacacactcttggatttaaaagcaatgggatgcaatactgttgaaacatatgtaccatggaatctacatgaaccatatcaaggaaaatatgatttttcgggtattaaagacattgaaacatttttgaaactagctgaggaattggaattatttgttatattacgagcttcaccttatatatgcgctgaatgggaaatgggtggtttaccagcatggttgttaaaatatcctcgtattcgtttacgaactaatgataaacaatatcttaaatgtctggatcaatatttttcaattttattacctaaattaagtaagtatcaaattactcaaaatgggccgataatattggctcaattagaaaatgaatatggttcatatggtgaagataaagaatatttattggctgtgtatcagatgatgagaaaatatggaattgaagtacctctctttacagctgatggaacatggcatgaagccttaaatgcgggttctttattggaaaaaaaagtttttcctacaggaaactttggatcacaagcaaaagaaaatattacagtgttaaaaaaattcatggaatcccatcaaattacggcaccgttaatgtgtatggaattttgggatggctggtttaatcgctggaatcaagaaataattaaaagagatccccaagaatttgtaaattcagcgcaagaaatgttgtcgttgggcagtgtcaatttttatatgtttcaaggcgggacaaattttggatggatgaatggctgttcggctcgaaaagaacatgatttgccccaaataacttcatatgattatgatgcgattctaactgagtatggtgctaaaacagagaaataccatttattgagagaagtaatcactggaaaaaaagagcgtttaccagagcggcgtcaaactaaaaattatggtcaaataataaaaaatcgaagtgtctctttatttagtacgcttgattgtattgctgcctgtcatcagtctgattggcctttaacgatggaagagttagatcattattatggttacgtggtctatcaacatacttttaaaagttatactgatgatttacggatgcgaattattgatggacgtgatcgagcaaaaatatatctggatgatcaagagattgctactcaatatcaagaagaaattggtgatgagattaatttaccgacacatagcaatgatactcatgatttaaagatattaatggaaaatatgggtcgggtcaattatggttctaagttacaagctgagacgcaacaaaaaggaatccgtaatggggtaattttagatatccattttaccaaaaaatggaaacattactgtcttaattttgagcatcttgatttattgaactgggaaaatggttatcaatcaggcccaggtttccatgaatatatttttgaagctgatgaagttaaagaaacttttattgatttggaaggctttggaaagggtgtggtctttgtaaatggtcatcattgtggcagattctatgaggccggaccaacactatcactatatataccaggtccgtttttaaaaaaagggattaatcaaattattatttttgaaacagaaggctgctatcgtgacaagattgaattaattggtcagccaaaatatctataaacagtagaagtattctgattaaaagaagtttaaattctagacaagtgaatttaaactttttttactaatgatcttaatgagaaatgattattaaaagaatatctagaaattatgatagaattcacttataatactatgaaagagctgttttatcgattgaggagggttaatatggctacattaaaagaggttgctgaatttgcgaatgtttcaatcgcaactgtatcacgaatattaaatgatgacaattcattgactgttttaccagaaacgaaagaaaaagtcatcaaagcagctgaacaattaaactatattcctaaatcaaaacgtaagggaaatcatgatgaagctttgacagtggcagttatccagtggtattcttttgaacaagaaatgcgcgatacatattatttatctttgattcaaggtgttgaaaattatttaaaaacaaatggaatcattgctaaaagaattagaaaagacgatatggatttaaataaggttttggaaaatgttcaaggaattatctgtattggtaagtttgaatttgaagtggtaaaagaattaaaggagtacactgaaaatattgttttgttggatatggatatcagccctgtaactgaatgttgtgtaactttggattttgataacgcaatgtttcaggtggttgattattttaaccgtttaggtcataaacatattggttttttaggacggggcgagtacgaagaattatcacttcatattagtactagaaagagtagttttattaaatattgccagtattttggcttgaaatatactgaattgctgctggaaaatgaattaacgagtgaagctggctataatttgatacataatttagctaaaaccgaggaacttccaacggctatttttgctgtcaacgatccaattgctataggtgcaatgcgggcattacaagatcagggaataagagttcctgaacaagtttctattattgggtttaataatattgaagctggtaattttactacaccatcattaacgactgtttatgcgccttcaaaggagatgggaaatcttggtgcgatgctgttacatgaaatgattttaaagaaaaaagctttatttccgatgcgagtacagttgccatgctcgttactagaacgtaaatcatgtaagaaaattatataaaattagtgttattaggatagtttttgctgctgtggtcttaaaatcaagaatgtttgattattaggccgctttttttattttacttaaataaatgttgaatttagtattatattatcaattatcggcgtaatgaaagcgctatctttttaatgaaataccagataaattatgttataatgggaatatctaagaaaagggggagtgacacatgctcgatgattttttaattcacgtatttcacaaaggaaatacattagaagcgtataaagtatttggtgctcatttagaaacaaatgaccacaaaaaaggtgtccgcttcaccgtctatgcacctaatgcacgaagtgtacaagtcgtaggtgattttaatgactgggatgggcaaaaccattatatggaaaggtatacagatggaggaatctggactttatttattcctggggtaaaagaatttgctctttataagtaccggattgaaacacaaaattttgcgacagtagatcgtgctgatccatatgcgttttatagtgagttacgaccaggaacagcgtcaagggtttacaatattgaacggtttcgttgggctgataaaaaatggcttaatagccgaacaaagaattttgataaaccaatgaatatttatgaagtaaatattggttcttggaaaatgaaaaaggattttacggcagaagaagacggtgaattctactcttatgaagagatgatagagcttctaattccatatttagttgaaaataactatactcatttggaattaatgccactgacagaatttccgtttgatggttcgtgggggtatcaagcaactgggtattttagtataactagtcgttatggtgaaccgaaaggtttaatgaaatttatcaatgcttgtcataaggcgggaataggtgtcattatggattttgttcctgcacattatgtaaaagatggacatggtctttataagtttgatggtggatttgtatatgattatccagatattaatcgtcgttatactgaatgggacagtgtttattttgatgttgggcgtgaagaagttagaagctttttaatgagtagtgttggctttttagctgaatatttccacattgatgggatacgttttgatgcggtaagtaacttgatctattggaaaggcaataaagaagctggagttaatgatggtgcgttagaattcatgaaacgtatgaataatcatatgaagggttattatcctggtgtgatgttgattgctgaagattcaagtgattttaatggcgttacaaaagcaccagatattggtggccttggatttgattataaatgggatttgggatggatgaatgatactttaaaatatatgaaactagatccagtttatcgtcaaggtgatcataatttactaacgttctcgatggcttatttttatagtgaaaatttcattttaccattttctcatgatgaagtagttcatagtaagggaactatcattgataaaatttggggtaataatgaacaaaaatttgcccaattaaaaacactttatacttatatgatgattcatcctggaaagaaattaaatttcatgggaaatgaattgggtgaatataaagagtgggatgaaaaggtagctttaggatggaatattcttaagtatcctattcatgattcctttcataaatttatgattagattaaatgaagtttataaaacatatccatgtatgtatgaacaggattatggaatggatggttttgaatggttagttgttgatgatcgagcacaaagtgtatttgcaattgaaagaaaaggaacggatggaagttctttaattgctgttatgaattttacaggaaacaaacatgagggatatatggttccagtaaatcagccaggaagttataaagaaattttaaatagtgatactgatatctatactggaagcaatttcgttaataaacgggctataaaagctaaagagggtcaaactttaaataaggaatattacataccagtaaatattgcgccatttggcagcatgattttcgaatataaaggctctaaataatgaactggtataagaggagataaaatgtttaagaataaagaagaatttaaatttgaattttcaagaagaattatagaatcttatggacgaactgtagaagaagcacatattactgaacgcttcttagttttggaaacaatggttcgtgactatgcttcagtaaactgggcaactagtaaagcgattattcgtaataactatcaaaaacaaatgcattatttctcaatggaatttctaatgggacgattattagtaaataatatgatgaacttaggaatatatcagattgctaaagatggtcttgaagaatatggaatcaatattcatgatttagaggagcttgaaacagatgctggtctaggaaacggtggtcttggaagactagcagcttgctttatggattcattggcttcactagcatatccggggcatgggcatacgattcgttatgaatatggattatttaaacaaaaaattgaaaatggttatcaaatcgaattaccagatcaatggatgcaaacaggatttaactgggaagtgagaaagccgaaacatcgagtaccagtaaagttctttggtaaaattatttttaatgaaacgacagggaaatatgaacatgttgatgctgaggaagtgtacgcagttccttatgatgtccctattgtcggtaatgatactacaaatactaatacgcttcgtttgtggagtgctgaagcaagtgataatattcctgcaaatcaagattttaggcaatatatccaaaatgttagagatatttgtcaaatgttataccctgatgactcaactcctgcgggaaaaatgttgcgtttgaaacaagaatatttctttacttgtgcaggattaaattctattgtaagggcgcatttaagacaatatccaaatttgaataatttccatcaaaaaaatgttatccaattaaatgatacacatcctgttttagcaattcctgaattaatgcgtattttgattgatgaacaaggatatgaatgggaagaagcatgggatattacgacacagacgtttgcttatacaaatcatacgattttagctgaagcgcttgaaacatggccaatcagtttaatgcagtcattattgccaagagtttatgaaattattgaagaaattcatcgacgttttattgggtatgttaaaatggcaagtgaccgtgatgaagagttattgaatcgagtaatgattttacgcgatggtacagtctacatggcgcgacttgcaattgttggaagttttagtgtcaatggggtggcaaaattacattctgatattctagcggaacgtgaattaaaagattttgcacaattatatccatcaaaatttaataataagactaatgggattacacatcgtcgctggttagcatattgcaatccagaactatcatcattaattagtgaatatatcggagatgaatggatcaagcatcctgaaagattagaagatctaatggggcatttagatgatcttacccttcaagatcgtttcttggcggtgaaaaaagaaagaaaacaaattttagctgactatattaaagaacataacggaattactgttgatgttgacagtatctttgatattcaagtaaaacgtcttcatgcttataaacgtcaattattaaatattcttcatgttattgatctgtatttaagaatgaaagaaaatcctgattttagaattgaaccgagaacatttatttttggggcaaaagctgcaagtggatattattttgctaaaaaagttattaagttaattaatagtgttggcgatgttgtaaataatgattcggaaactaataaatacttaaaagtagtctttttagaaaattacggagttactttagctgaaaaaatcatgccagcggctgatgtatcggaacaaatctcaactgctggtaaagaggctagtggtacgggaaatatgaaatttatgatgaatggtgcgattacattagggactttggatggagcaaatgttgaaattgcagaattagttggtgaagaaaactgtgtaatctttggaatgaaagatcatgaagttaaagaattacaaatgagtggtgcttataaggcatgggattattataataataatccaagattaaagagaattatcgatagcttgatggatggtacattccatgagaatcgtgaagaattccgggttatttttgaagagttaatgaataaaaatgatgaatattttgttttggctgattatgaagcatattgccaagctcaaagttctgtgcgtgatctatataaagatcgttcaagatgggcaaaagtatgtctaacaaatattgcaaagagtgggttcttctcatcagatcgaactattcaacaatatgttgacgatatttggcatttagataaagtaaaattttaagggattgaaaatccctttttcttttgattaaaattggtatataagttattgataaaacccaaattatctgtatatagtctaaaaaaatgctgattatctacattttatatcattgctatctgagaagtgataggatataatgaacacgagatgaaagggtgaaaatcatggaaaaaagtgccattagaatgattgcaaagatggtatctgtaaataaaatcgaagtacaattgattagaagatattacgaaggaaattgtcctcgtttttatttgagagatttaaataataatactttgatagaaatagaaatatccgctaaatttgtagaagaagaatacgttcattactatttcgataatgtcgaaatagatttttgtcatgtttatcaaattgtagatgcatatggtttagcggaaaccctccaatatactcaactgatctatgatgctgagtttttaaaaaataactattatgatggtaatgatttaggaaattcatatcatgaagattatacgatttttaaagtatgggctccaacagcgttagctgttaaagttgcaattactaaagaccatactacatatagttatgaaatgaaaagaattggtaacggtgttttttgttcatatgttgcgggaaattttgataactgtgagtatgtttatctagtacgacatcatgatagttatattaaggcattggatccatatgcttatggatcttcatcaaatggtaaaagtagttatattgttgatttaaataagattaagatcgacctgaatcgggaatgtttaaagccattaaaaaataagacagatgcgattatttatgaagctagtgtccgtgattttacgatgtatgaaaacagtttaagtaagtacaaaggaaaattcgctggaattagagaaactgggttattgactaaacatggtaatagtgcagggttagattatttagtggaattaggaataacacatatacaattattgccaatctatgattttgcgactgtcgatgaaaatcaccaggaagtactatataattggggatatgatccagctcagtataatgttcctgaaggaagttattgtacaaatcctaatgatggttacagcaggatcgttgagtgtaaacagatgatagcagatctgcatgcgaaaggaattcgggtagtgatggatgttgtctataaccatatgtatgatgttaatgcgagtgcttttgaacgaatcgtacctggctactattttagaaaaaatccagatgggagtttatcaaatggttcatggtgtggtaatgatttggatagtggtgaacatatggtgcgtaagtatattatagatatgtcgagacgctggcaaagtttttatggtgttgacgggtatcgttttgatttaatgggaattattgatattgaaacgattaatcgtgtctatcaaatttgttctgcttacgatgcttcatttatggtttatggggagggttggaatatgccgactaatttaccagatgagcaaaaggcgatgcaggataatcatgcaaaaatgccgaaaattagtttttttaatgatgaatatcgtgaggttattaaaggtggaagcagtgataatgttttagttaataaaggttttattacgggaaatctttacgaaacagaaaaggcaagaaatgtaattacagcgactaatcgttatacaagtccggaccaatcaattaattatgttgaatgtcatgataatgcgacggtttttgataaattgtatatttctaatgttgaagaaggtttagatgggataataactcgacaaaagaatcttacgatcatggtgttattgtcgcagggaattccctttatccatgcgggacaagaattttatcgaactaaaggcgggattgggaatacttataattcacctgataatattaactgtattaattgggattttcgagatatttataaagatgatattaatgagataagaaaaattattcaattacgtaaagataataagtgttttcgctatgcaactagaaaagagattgaagcaaatgttatggttgaaaatattgactttaaaatgttaaaatatactctaaaacaagatgaaggtgaatatcgtgaatttgttatttacattaacccatcaagttttacatttgattatgaagaaactgcttatcagcacctttatggtgaaattactgatcagcaaataggagctagaacgattgttgttctagcaagataggagaattaaattgaaattaattgtaggattgggaaaccctgggaaagagtatgaaggaactcgtcacaactgtgggtttatggtagtagatgaattagctaataaattaaatacagaaataaatcagaataaattcaaaggtttatatacaaaggtaaaatatcatggagaagatgttattttattaaagccgcaaacatatatgaatctttctggtgagtcagtaattgctgcaatgaatttttttaaactggataaagaagatattattgttatctatgatgatctggatatgccggttggtaaattaagattacgtaaaactggcagcgctggggggcataatgggataaaaaacattatcgctcatttatctagtcaagattttaaacgaattcgtgtgggaattgatcgtcacaagtatatgaaagtagttgattatgttttatcaaggtttgcaaaagaggagactgaagcaatcaatcaaggaattgataaggctagtgatgctgttttggattatcttgatcatgattttgattacattatgaatcgttataattagaggtttatatgaagaagatagatgaaatattgaaacaaaaccctgcctttaaaacattgttaaagggagaggggaatatcattgttaatgatcttaacgatgaggcactattagtaactagtgcctttttgacattacaaaaagatattattgtaattaaaccaaatcagtatgaggctaacttgttgtatcaacagatttcattgattaatgaaaaagacagcttattttttccagttgatgagtcatatcgaattgaagctttagcctcatcgccagaactattaggacagcgaattgatgctttatatcaattgacaactgatcagcctaaaattttaattactcatggacaggccctggtacggtatttaccaagtagacagttatttttagataattgtttaaatctaaaaacaggaatgcaaattgatatatatgatttgcaaaaacttttgatcaaggctggttatacatcagcaccgcgagtagatcagccgttttatttttctaaacgtggtggagtaatcgatgttttttcaattcaatatgataatccattacggattgaattttttgatgatgagattgataatatacgtttttataatcaaaatagtcaaagaacgatagaaaaggttaaagaagtaaccattattcccgctagtgatattttatatgatgaacaagaagtcccggctgttttaagtaaaatcaatgatttaagagaccggcagattgaagaacttgatgagttatatcaagaagattatttaagtaaagtatcaatagatcaagaaaatttgcggaatcatgatactagttttacgatgtatggttattttaatttatttaatcagacagctagtttattagattatctcgataccccgctaatcatccaagcaaacaatcatgatattaattttgcttataagaactatttagaagaaaatcattattattatcaagaattggctagtattgggaaaactattaaaggtttgaatctatttagagatttatatgaagtgattgatagaaaatcagttaattttaaaccttttgctcaaagtgataaagatgtgttgtttaatgctcgtgctattatgatcaataatgatgatgaggcaatgattattaatcaaattagagcttatttaaagttatcaaaagttgttgtagctttagatgatgatcatcaattaaaattaatgactgaattatttgatcgtcatgaaatggcatatactttgattgggataaaagatgaaatatatccggggttgaatattgcggtaaataaaattggttttggaatcgaattagttgatgaaaaaattgttattataagtgcaaatgaattattcaaaacacgtaatattaaaaaaccaaaatattttaagtataagaatgcaaaggttttaaaagattatcaagaattaaatattggtgattatgttgtacatgataatcatgggatagggcaatacttaggaattaaaacattagaagttcaaggatttcataaagattatttatatgtagcctatgctggagacgatactttatatataccggttgaacaatttaagatgattaggaagtattcaagtaatgagggtaaagttcctaaaattaataaattgggaggctcacaatggcagaaaacaaaagccaaagcacggagtaaagttgatgatattgctgataagttaattgaaatttattctgctcgtattaatcagcctggctatgctttcccaagtgatagtgagattcagctggagtttgaacgctcatttggttatgaattaacagttgaccagttacgttcagttgaagaaattaaagccgacatggaaaagagtcagccgatggatcgcttgctatgcggagatgttggatttgggaaaacggaagttgctttaagagcagcatttaaggctattctaggaaataaacaggttgcttttttgtgtcccacaacaattttatcaatgcagcattataaaacaatgattgcacgatttaaggattttcctgtcaaaattgctttattgaatcgctttacatcgactaaggaaaagaagcagatactaagtgatttaaaattaggaaatattgatctgcttgtagggacacatcgaattttatcaaaggatattgtttttaaagatattggattattatgtatagatgaagaacagcgttttggtgttaaacaaaaagagaaaattaaagagtatcgtaaaactattgatgttttgacccttacagctaccccgattcctcgaactttacaaatgtcattgatgggaattcgcggattgtcacaaattgaaactcctcctaagaatcgtcagccagttcaaacatatgttattgaaaaaaataatgttttaattaaacagatcattgaacgagaattagctcgtgatggacaggttttctatttgtataaccgaactagtcagattgctaatgttgcttataatattactttatcagtacctggggcaagggtagcggtaggtcatgggcaaatggataaaaatgaattagaagatgtaatgatgcgttttgtgaacaaggaatttaatgttctcgtttgcacaacgattattgaaacaggaatcgatattcctaatgcaaatacgattattgttgaagacgctgataaatttggattaagtcagttataccagattaaagggcgcgtagggagaagtaatcgtggtgcatatgcttatttgttatataatcctactaaagttttaaatgaagaagctagtaaacggcttaaggcaattaaggagtttactgaattaggaagtggatataaaattgctatgcgtgatttagcaattcgcggttcaggagatattttgggtggtacacaatcaggctttattgattcaattggttttgagatgtatatgaagattcttcaagatgctattaacgaaaaaatgggtaaagaggatgtggaagcagaaaaagaaatcaaaagtgttaatgtcaaagttgatggatatattcctcatgattatgtatctagtgatattgaaaaacttgaactatatcagcgtctagataatgccaaaacgataagcggtgttgatcatctaaaatcagaatttattgattattacggtaaattaccagaggaagtaagtacattagtagaaaaacggaagttagatattttagcatctactgaaattattgaaaacttagcggaagttaaagggaagatggaaattacttttactaaaggatatagtcaaaatgttaaaggggatcaattgtttgaattagtcaatcgacttttcactaaacctgtgtttaggcaattaggtggtaaaattgtaattgtcttgccaaaaggtgatcaatggcttgagcgaatcaatcaattgataacgacattaaacagttagcaaacagagtattcttgaatagggagatttgtttttaaagcaaatctcttttttttgttagaaaaactaacaaaaaatgaacaatgttcattgaatgcttgttgatgatagcatataataagtgtgaaaagagatgatgagatgactagtcagcgttttaataaaacaattgaacgaaaaaaagagattatcaaagctgcgatgcaattatttagtgaaaaaggatacgcgcaaacatcaatgcgtgatattgctaggacaatgggagtttcgttaggtttgtgttatcgctattttgattcaaaacaaatactatttaatacagcaatcgatctttatattgaagagtgttgtaatagctatcttgctattttacatgattctactattacgattaaagataagatagatgcattatttacttcaataggtgatgagcattcaaatatgcaatattatgatttttttcatcgtgttgaaaatgaagaattacatgaacaattatcaatcaaattatgcaaatatatgtatccacatttattagaagcagtaaaaaaagctattgcagctaaagaaatatatattgaaaatcctgaggcattaattagttttattatatatggtcaagttggattattatctaaaagtaatattgatcatcatgaagttgcaaaattattgaatcagtatgttaatcaattaatgaaatttaatccctgactctagggattaaaattaaaacaaaaaaatgaacatcgttcatttaaggagggcattatgaataaaaaagaacaatctagacaaacatttgacttacaggcttcaaaatatgatactactttttatggaaaacatgcccgtaaaatttatccatatcttttaaatgaaattattcgctgttatggtgaggaagtacttgatttaggatgcgggacaggagctttaatgaaacaagttattagtgaggattcacatcgacatcttacaggaattgatttatcatcacaaatgattgaaaaggctaaacaccaacttaagaataaggcgactttagtagtaggagatagtgagaatttgccattttttgatcaaacttttgatattgtttattgtaatgattcatttcatcactatccaaatcctcaaaaagccattgcagaaatatatcgtgttttaaaaattgggggaacattgattattggtgacacatatttgccagtcattgctcggcaggttatgaattattttattcgctttaataaagatggggatgttagaatttattcaaaaaaagaaatgatttcgttcttggaagaattatttcatgaaataaaatggataaaggtatcgaatagtgcttacatgatcaaaggagtaaaataatgatacaagcaacaaatcgtaaatatttacgatatatttatcaattattgttggagggaaaaaaggtacgtcaaattgatttggctttatctctaggatacgcacgttcaagtgtttcaattgcaattaaacaattgaaaaaagcagggtatattgatcttattaaaaataacattactttaacagagcggggaagtatgttggcacaagaaagtttgaaaagttatcagcaagtttatcgatggatattggctttagggttaacttcatatgaagcaagattatatgcggataaattagaaagtgattttgatcaaaaatttattgagatgttacttaaagacaaaagactaaacaattaattgtttagtctttttgtgaactgtaatttgctaaaatcgtatcaaaatcaagaccgattttaaaacctaatgtaaaataatcatcaatacagttttggaatgcttcaaaactgtaggtttcattaactttcaatgcgctttgataaaccttgattagttgattggcaatattgttggagttgttgatttcttgatagttcttgagtttgtcaacgtgcaattcaaatccgattgacatcaacatatgaagggcatcagtataatagttaaggatttctttgttattggcagatgaattatcccaaaagctaaatacttttgcttcttcaccgactttacctaattcacaaagaaaagctagtacttttgcttcaaccttatctttatttaaaacatcatgattaggatcaacgaccaattttaattcgtggctcatatgcgcttggtagattttattaatttcattcatttaattatcacctcttaagtattattatactcttttatgtgacattttcatgaattatgataattcaatataatcatgacgcaaatattcttttgtataggtattattggttagatcttgaataatagttagaaaagattcattttcaagataacaggtataactaacccgatctaaatactcggtattaatgcatttaatatgatgtactttaattaagtgttcaaattttttagtgtatgaataatccactgtaattttatataaaggaacactgaatttttctacaatctcagctccttttaaagcatcagcaacactttgacgataagctcgagttaaaccgccagctcctaatttaatcccgccaaaatatcttgtaacaatagcaatgatattagtaagtttatttttttctaaaacatctaacattggtaggccggcagttccgctcggctccccgttatcattggcacgtttttgggtaccaacgatataagcaatacagttatgagtagcatcatgatatttttcttgatattctttaataatattatcaattgcagtttcgtcattacacggtattaaagtacaaataaattctgattttttaattatccatttatatgtagttatttcacgtactgatttcattaaatccctcatttctttattatcataacacatattactagcaaaagtatgataaatttggtatattagttacgtaattatagggagggcgagaccatgaaaaaaatagctgttttagcagatagtggatgccagttaccaattggttcgttagaagatcaaggaatttatattgtacctttaacgattacaatgggtaataaaacatatttagatttagaagaaataagtgctaatgaagtatttgaaagaatgaataaaactggggaaatggtgatgacatcacagccttcaacaggttcaattcaaaatgcagttcatagaattaaagatgcgggatatgatcatattattgctttgccgattgcaactggattatcttcaaccttgaatggaatgaaattggcttgtgatatggtgggagtaccagttacgttaattgatactaagggtacggctagtaatcatcgctatttaattagggttgctaaaaaattaattgatgatggtaaaagtgttgcggaaattgaaacgattttaacagcaatggttgaggattcagcgactgtgattatggcacctaatttagaccatttaaagaaaggcggacgaatcactccagcggtagcactattggggaacttattaaaaatagtgccggtaatgaaattaaattatgagttgggcggtaagatcgatactttagataaagttagaacggtgaaaaaagccaacttaaagatagttgatcatttagttaatgaatgtggattgaacaataaagactttattattgctattgaacatgtcttagttgatgatttagctcatcaaatgaaacaggcgattattgatcgaattggtgaatgtgagattaccgttcgagagttaccagcggttgtaggagcacatatgggtgttggtggcgttggatatcaatatataaaaaaatacgagggattaacatggaacgaataacaagttttagtgttgaccatacaaagttaacaaaaggtgtctatgtatctcggatagatggtgaattaacaacatttgatatccgcatgactacacctaatttagagcctgctttagatcctcgtggtgctcatacaattgaacatatcggggcaacattacttcgtaacggcgaaaacaaagataaaataatttattttggaccaatgggatgtatgacaggtttttatttaattacaaaagaattagatttggctcgagtaatcaaaattgtacgtgaattatttgaacagattgcaaattggcaagaacccatacctggagcgaagatggaagaatgtggcaattactcatttatggatttagaaaaagctaaagctgcggctaaacattttgttactagcgaatggcagcatgaatatcattatttatagttaaattaaaacatgtttcgaattttgaaacatgtttttttatcgagaacatctatttaattttgtcattataagcgtatattattctatagaggacaaatatgtataaaggagtgattcaaaaacaattagaacctgaccaaagaaggtatttggtactaaattgttatgagtaaatgaattataagaaccaacaataattggtagtgttacattttgataaagattagaattttcattggcaataaaactaattatatcgatgttatttttaaaagcattatcgacaatttcaactaatcggggtgtaattccagaattagaaatcacaataaatagggaattatcttgatatttaatatcaagcatttcagtatggacaacattcattgcataaaatccatttagggttagacgctgttgcaaataatcagcaattggagcagagaatcccatcccaaaaacgatgatattatgttgacgatgtttatttaataattcaatgaatgctggaatatattgttcaagatcatcaggagaaaaaagctgggtattattcgatgatgacagctgatagatcatatcactgtagccactaaaaccaaatttattgcaaagacgataaattgcagaagtagatgtgaaattagcgctggccatttgccgaatcgtaatatcttttaaattattttgattatcttcaagatatttaactaatgctaattcaagttcatttaaatcaaatttatctcttaaatgttcgatattcatattatcacctcaattagattatgtcacagattagaaaaaggagcaagtttatggcaaaaacgatgtacgacccatggtcaaagattattacaagaaatggttatgctggagatgaggtaatatcagctttacagaaatcaattcgtcgcagtttagaagaacaggcatgtatgttcgcctatgaaatgtatatttcttcaccggaattattagaaaaaatgtggcgtcgattattaactatttcggtagaagatattggaatgggagatccgatggctgcagtattagtaaataatttatatcaaatgtcaaaacattttgattatgctgatggtgatcaaccaatgtattttatccacgcgattagatatttatgcagttgtcaaaaagatcgttctagtgatttattaaaaaatatctgtattaaatcttttgcgatgggaaaattaccggaaatacctgatgttgctttagacaagcatacagtaagaggaaaagccatggggcgtgattcattccatttcttgaatgaagctagtaaagttattccacaaatggaggtggataacgattataaagaacgctatgcaaaaattcttgaagaatatgatccagagaatgttagtgaaacagcgttcacttttaatggttggcaattttaatagggggataaaaaattgattagtaaattagagaaattattaggaccaattgcaaataaattggctcagcagcgacatcttcaagcaatttcatcgggtatgatgatgtcattaggattaatcgtagtagggtcagttttcttaattattgccaatccgccaattaatttagacttggttgatttgaatacaggaaatatctttttaaagtttttaattagctggaaacaatttgctttagctaattatgatgttttaactttaccatataattatacaatgggcttagttggtttgatttcagcttttggggttgcttattgcttagctgaaagttataagatgaaagcttcggtttatgggataatttcgatgtgtacttttttaatggttgcagctccattaaaggatggagctattacaatgagttatttaggtgcggatggtctatttgttgctttaataatttcattaatatcagtagagatttcacgagtagtcagtcatcgaatagtctttacttttccagatagtgttcctagtgcagtgactaattttgtaaatagtttaatgccattagcgctaaatatcattgttatttatggggctaatttgattttagtagctttatcagggaaaagtatgccaaatttaattatgtcgtttttaacacctgcaatttcaggggttgataatgtttggatgtttatgggaatttatttattttcaaatattctttggatgtttggaattaatggttcttcaattgtatttccaatagtttttgctttggggattgcgaatacgggactaaatggtgaattagtaaatttaggaaaagatccaacagcaatcatgaatttacagatgtttagatatgctttattaggtggagctggtaatactttaggattggttttattaatgtgtcgttctaaatctaagcatattagctcgattggtcgtttaagtattgttcctgggatttgtggaattaatgagccaatcatgtttggggctccgattgtattaaatccaattttatcgataccgtttttagtaatgccgtgtatttcgattggtttagggtatttagttcaaaaaattggattagtttcaatgggatatatagttgatccatcatttacgccattttttgctcaaggttttttgtcagcattggatattcgtaatgtaatcttcatgattgttttgattattatttcagttggagtatattatccattttttaaagtttatgaaaaaaacacacttgcaaatgaagcagaataataaagtggccgatgccacttttaatatggaggaaagatgaaaaataattatgatgttgtggttgttggagcgggaccagcaggaatcatggcctgctatgaactgtatttgaaacagccggaattgaacgtattgcttatagataaaggtcaggatgttatgaaacgtcactgtccgatcaaggaaaagaagatcaagtcctgtccaatcatcaggaacaatgaaccgggctgtcttcctgcctgttcgattacagccggatttggcggtgccggtgcctattctgacggtaaattcaatattaccagtgaatttggcggctggctgactgactatctttcaaccaatgaggttgaagatgtaatcaactatgttgacaatctttatttaaaacacggagcaaccagagaaataacggatcctacgactgacaaggtcaaagaaattgaacatcgaggctatgcagtaggattaaaactgctgcgggccaaggtaagacatttaggaacagaagagaatctgcggatcatgacagaaatgtcaacggaactgaaagaacatattgatatggcatttagaacagctgtaaaggaagtgctggttgaagacggacatgctgtcggggtagttctggaaaatgatgaggtcatcaaagcgaagaagatcgtactggcaccgggacgagacggttctgcctggctgacaaaagtactgaaacagcatggactggagctttataataatcaggtcgatataggagtgcgggtagagaccagcaatatcgtaatggaagagatcaacagcaatctgtatgaaggtaaatttgtctataatacaagtgtcggaacaaaagtaagaacattctgttcaaatccgtcagggcatgtagtaatagagaatcacagcgggacgatgctggcgaacggacatgcctatcatgatccgaagctggggagcaagaataccaactttgcgctgctggtatcccataccttcagcgagccgttcaatgaaccgaatgaatttgcacatgaggtgagcagactggcgaacaagctgtcaaacggatcagtcatggtgcaaagatatggagatatcaagaaagggagaagaacgacttacaagcgtttgaaagaagggtatacagagccgaccttagcagaggcggtaccgggagatctggggctggtattaccgtacaacacgatgaaatcaattatcgagatgattgaggcactggataatgtaacaccggggatagcgaatgagcatacgttgctgtatggagtggaagcgaaattctattcagcgcggccaaaggtaagagaagggtttgaatgtgaaatagatgatctgtatgtagcaggtgatggagccggattaacaagagggctggctcaggcaggagcaaatggaatcatcgtagcacgtcatattattgggacaataaaaaatagagatagtaaattagcgtgaaatcatttaatttagatttcacgctttattttataactatcttttattaattaaatttgttcagttgttagagctgaaagagtatcataaatatagctttcatctattttatcacacatgacaataatactatcactggcttttaaataagtgtcaccatggggaatgaattcttgtccatcacgtctaagtgaaacaatcaagcagtgattaggccattgaatttctttaactaaatgattatccaatggagaattatgtaaaatcataaaatctaataatactttttctccaactccctgtggagttggaagacttcttttctttaataaattttctaacaaactttcgtaaattggtttagattttaataaatcggcaacaacataagcaacgatagtaacaatagcaattgataagaggtgatttaaagaacctgtcatttcaaaaatcagaataattcctgtcactggagcccttacaattgcagtaaaataaccagccatagccagtagaataaaattattaatataaataggatctaaacctaagtaatcgacggagatattagcaaaagcaccaccaatcaaacagccaattactaatagtgggaagaaaattccacctggagctcctgagccaaagcaggtaattgcaaataagaatttccctgccagcaaaagaagaattaaggacattgttaattttccttcgattaataagtcgaccaaagtatcgccactacctaatagctgaggaacagtgaatcctaaaattcctgccaaaataaaaggtattaataatttagtatagttatttaaatgctttgagtgattatagaggctttgaacaaatagtaaggctttattataaaaagcgccaagcagccctaaaatgattcctaaaataataaccatccaatagtattgggtaggcagagttccatgaatattgaaagaaaatacaggagccattcctaaaatagaactcataagataatcggcggcaattgatgaggtcatcactgaaatcaatagtggggcagaaaaatgtttatgtacttcttcaagggcaaacattactcctgccagcggggcatgaaaagcagctgctaatccggcactggcaccacaagtaagtaaatagcgttcctcagtcttaccacgttttaaaactttaccaattcctttaccaaccattgcccctaattgaattgaaggaccttcacgaccaagggctaaaccagaaaaattagctaagaaaccaccaaaaaatttagcaatcaaaactcgccaccatttggcatcaatcttacctgccaattctccttcaagctgtggaatcccgcttccagaaattaatgattcccaatcgagtaattttgtgacaactagtgctatcacaaataggataacaaaccagataattattgtgaatattgattgtttacaataggctaaaattcgctgtaaccaaagagctccattagttaaacaaattcgatatccaacaattactaatcccgctaatattccgaccagcaaaccttctagtaataatactaatttaaatcttttgatatttaatgttttaattaatctatttttcatatctactccccattcctaggacattatagaacgattagtagtaaaattcaaaggttgttttgaagcagaaacaataaatgtttcaattattgacaaaatattgtacaattaaggaggtgataggaatggacaaacgctcagatgcaatcgagacagtagttgatgtttttaatgaagcaatggttatacaagaattgtacctcaagaagagcaaatttaaggaattatcgatgagtgaaactcatgtccttgatgcagtggataaggtagaatttccttcaatgactaatgtggctaagtcattaagtgtaacgatgggaacattgacaacagcagtaaagaaaatagttgaaaaaggttttttagttaaagagagatcaagtaaagaccaacgagtttattatctaaagttaacggataagggacatgaagcattggctattcatgaacagttccatcatgaattggcagatttatacaaatcagcaattcctgacgatcgagttgactgggtctttaatacgttaaagaagattaagttggatttggataattataaaaaggcattagaagaaaaataagtgggcagccactttttttgcttaaagataaatatgattaaaaaataaggaataaaagggcaagaaattaaattcttgccctttaagtagaaaagtatttacgttacactatatttaatggttatttaaaacgatattattagtggtaaaacacaagttttagtgtgtaatatttatttaaataatttatctaattgattacttgccataacgattatactaattgttttgggctgataggaactgataacttttgcacaagtcatgatagtattgcctgaggtaataacatcatcaaaaattatcacattttgattatataaccgctgaccatctttaatcttgataatctgacttacttgactgcgatcagtttggctggtctgtttataggcggaatttttgtataaaccagtaaaaatatgattactaaaacttcttacaatcatttcatttgggttaaaacctcgtcttagatcgtcttgttggctgctgggaacaagcgcgatgagatgacgccgatatttggttttaaaatgaggatatgcattcaaaaaagcatcttttaaagcataatcaccttgtcctttatattgaaataacaattgtttaaagaaatcgttatagtaatataaaatcgtaagtttgtaaccatgatagtcatgagttcgattatagattgaaaattggttaagacaatgaaaacatagtgtagcatgataataaagatgatataagctaggtgatttattgagatcattaaaacagattaagcattgtcctgcttgattgttttgagacactctttaattgccctggtcttgtatggagtaaaaatactaatacttccactgggatgtgctgttttacgacctactcgtccacatatttgaatcaatgtagcagttgtatatatccgattattgccgtataaaataattacttgaacattatcgatggtgatgccgcgctctaaaatagtcgttgtaactaaaacatctaattgatgatgtctaagacgttctataaatttttgaatatctttagtgttagagctgatagcatgacttttaagtttaaacagtttaaagatgcgggcaactgtatctgttaattgtatggtgggaacataaacaagtacgggttttttctttttgacaaaatctctaatttttttaattgcccaaagatacattaccaaagatgaagttagatagcacttgggaacatctagaagataaccatgatatcgtttggtcattaataaatctggttgattggttagagttgcagacatataaatatagttgcctttaatgctgttttggagtagaccaattaagacttcgttatttacgtaagggaaagcatccaattcgtctaaaattaataagtcaaaatattggggatagcgatataactgatgagtagtacaaataataaattgcccatctaccaattcactatgaccgccataaacagtagttattgaaatatttttgaattgactttgcaatcgctttgctaattcaattactagttcttttcgcggtgtagtaaagcagactcgctgcccctggtttagtgcatatttaatgacctcataagttatttctgttttaccggcaccacaaaccgctttaagggaagtgttgagatgctgctgataacgttgaagtaattgtctggaaatattattttgtaatggtgttaattcgtagtcgagctgataatcaactgtcttaataatagaaggtaattgtgaaggagaaaaacaagttgaaccgatcttaacgcacttacggcaataagtaatatttttgaaagtataaaaatattgtgaatcttgattcttacatcgtggacaaatcatcttatatcacccacttatattgtaactcaagatgctaataaaagggtctcaacttgatgctaaatttgtttcaagaaagttttattttttttaaatgaaaatagagcatatatcgactttgattaccgaatttatacttgacgcgacaacagttctatcaaaatagaacaaaattcttatattggcaaactttgtcgagtgaaatgaattcatctttgaaaacaataataatatactaacattgaccatattattaaaggggtgaatgagatgcaaggaaaagtgaaatggtttaacgcagaaaaaggttttggattcattgatcgtggtgaaggcaaagatgtatttgttcattatagtcaaataactcaagatgggtataagactttaaatgaaggtgaactagtagaatttgagctttatcaaagtgaccgtgggatgcaagcaaaacatgttgttaaaatctaagacaagggataaaaccttgtcttttaatttggactttaaaataatatatttaaatgttataatacggtagactaaacctattaaagaggagcgtatttcatggctagtagaaaagagcaaataagaaaagagttaaaaaagaaaaatgaaaaagagggattaaatcctgaagcagtaacaaatatcgttgatttgcaagatcaaaccggtgaagatataaaggttgaagatttccaaggaatctataatggtgaagtaattccatttaatacaacaccacattcaacaaaaaaaagctttattgggagaattaaaggtgtttttgacgatgaacgaaaacaattaaaaaaattagataaaatggctgacgaagtaattgctttagaatcaaaatatgcagcgatgagtgatgaagaattagcgggtcaaactagtattttcaaagaggctctagctaatggtaaaacgcttgatgacataattattgatgcctatgctacagttcgtgaagctgcttatcgtcaattaggcctaaaagctttcaaagtacagttgatgggcggtatcacattacatgaaggtgatattgcagagatgaagactggtgaaggtaaaacattaacttcgatttttccagtatatttaaatgctttaactggtaatggtgttcacgttgttactgttaatgattacttagcaggacgtgatgctgtaaataatggcaaagtatttaactttttgggattaacagttggattgaataaacgggagctaacacctgaacaaaaacaagaagctcatgggtgtgatgttacgtatacaaccaatgccgaattaggatttgattatttaagagataacatggtaactcgtttagaggataaagtattagtaaaagggttaaattatgcccttgtcgatgaggtcgattcaattttaatcgatgaatcaagaacaccattaattatttctggtggtcgtaaaaatacagcagcgttatatttacaagctgaccgttttgttaaatctttgaaacaagataaagattatgaagttgatatcgaaagtaagacggttgctttaacacctgatggaattgctaaagctgaaaaaggttttaagttggataacctatatgacccacaacatactgcattagtgcatcatattaatcaagctttgaaagctaactatacaatgactcgcgatgttgaatatatggttgctacagaagatggtactcgtgatattcgtaatgcaaaaattatgattattgaccaatttacaggtcgtgttatgcctggtcgtgcttattctgatggattacatcaagcaatcgaagctaaagaaggtgttccaattaaagaagaaacagaaactagagcaacaattacttatcaaaatttctttagattatttaataaattagcagggatgacaggaacagctaaaactgaagaagaagaatttagattgatttataatatgcgtgttattgagattccaactaaccgtccagttattcgtgatgatcgcaatgataagatttattctactagagctaataaattcaaagctttatgtgaagaagtagaagctcgtaattcatatggtcaaccgattttgattgggactgtttctgttgaaacatctgaagtattatcaaaaatgttagatcgtcgtaaaataagacataacgttttgaacgctaaaaatcatgctaaagaagctgaaattattgaaaaagctggacaacgtggagcggtaacgatcgccaccaacatggctggtcgcggtaccgatattaaattaggtgaaggtgttgctgaaattggcggtttagcagtaattggttcagaacgccatgaatctcgccgtattgataatcagttgcgaggacgttctggtcgtcaaggagatcctggttattcggttttctatgtatcatttgaagatgatttaatggaacgtttcgctggagaaagattaaaatcatttacagattatttagaagatgatcaagcaattgaaaataaaatggttactaaagcaattgaaggtgctcaaaaacgtgttgaaggtcaaaactttgattctcgtaaacatattcttgagtatgatgatgtaatgcgtcaacaacgtgaaatcatgtataaagagcgtgatgatattatgtctgaagaaaatttggatgctatcgttaaaggaatgtttaatcaagcaatagaaatgactgtccgccaatttacaaaacatgatggaaaagatgatattgtagatgttgctggagttgttgattttgttgctaaaaactatatgttattagttgaagtagaagctagtaactgtgaagcattacaaaaagatccacaaaaattaattgaaacattaacggatttagttttcaatcagtatattagtcgttttaataaagagttagagccagaaaagaaattacaatatgaaagaagtattcttttaggagtaattgactatacttggatcaatcatattgatgctatgactaaattacgtaatggtatttatttaagagcttatgcgcaaaaagatcctttagctgaatatacagaagaagctttctacatgtttgaacaaatgacatcaagtattgcagatgcaatttctcgtaatattgtccatatgggaatccgtcctggtagtgaagtagaacaaactatccctcatctaaagatggaacttacatttaagtaatggaattatacgaaattaaaaatgggcttactaaagcccatttattaatgacggagttttatcaatcaattgatattgaagcatatcgtcgagagattgaggggctcaccgtaatcacactacaagagggattttgggatgatgctaataaagctaaagtgacttatgataagttaaataagatgaaaaaaacaactgatcaatatgatttattagaaacgacattaactagtttagatgaaacatatgagcttgtaaagaatactgaggatcaagaatttaaggaaattcttgaaagtgattatactgtttttgaaaaagaattatcaaaatttgagacaatgatgttattgtctggtgaacatgacgatttaaacgcaatcgttgaaattcatcctggagcaggtggaacagagagtcaagactgggcagaaatgttatttaggatgtatcaacgttatgctgctaataaaggctggaaagtcgaggttttagattatttagatggtgatgtggcaggaataaaatcggttacaatgttaataaaaggggataatgtatatggacatttaaaggcagaaaagggagttcatcgtttagtgcgcttatcaccttttgattcagcaaaacgccgtcatacttcgttcgcatcggttgatgtaatgcccgaatttaataacgagattgaaattgagattcaaagtactgacttgaaaatagatacttatcgagctagtggagccggtggtcaacacatcaacaaaactgattcagcagttcgaattacacatttacctactaatattgttgtaacctgtcaaagccagcgaagtcaaattcaaaaccgtgaacaagcaatggtaatgttaaaaagcaagttatatcagttgatgctggaaaaacaagctagtgaattaaaagaattaaaaggagagcaaaaagaaatagcatggggttcacaaattagatcatatgtacttcatccgtattcgctagtgaaagataatcgtagtggatatgaatctaataatcccaaagctgttttagatggggatcttgatggatttatatatgcctatttaaaatcagcattgtaaggaggacgacatcgtgaagaagcatatttatgaaacactgattattattgtcggtaattttattttagcgttaggaatctgtgcttttattaccccggttgggttgattacaggtggtgcttcaggtatcgggattgctgtcaaatcattgacaggaataaatatttcctatactgtgtatgcaataaatattgtaatgtttgttgttggttatttttactttggtaaaaagtttgcagctggaaccttgttaagtacatttttatatccaacttttttagcaattttagaacgcgtacctgctttatcaacgattactagtgatgctttattatcaactctatatgccggattatgtattggcttagggttaggactagttttaagagttggagccagtactgggggaatggacattcctccattgattgttaataaaaaaaccggcttttcagttgcctggctgattaatatatttgactgtgcaattttgctttttcaggtgattttttgtccaattacaattgaacaggttttatatggaattacagtagtgattattacaacgattgtgatggatcaagttatgatgttgggggaaactaaagtacaagtaactgttatttctcctaaatggcaggaaatccgaaaaattgtttttgaggatattaatcgtggctgtacattattaaatgttacaactggatatcatcaaaaaaatcaatatgcggtaatggctgttgtgtcgaaacgtgagctgcatttattaaatgacatgattttagcgattgatccaactgcatttattattagtaatgctactcatagtgtaagggggcgtggtttcacgttgccaccaattgatttataaaaaaagaaatcataagatttcttttttttgttgtactttttgtgatcaatcatttttatttttttcaggattatttaaatcaacaaaaaattcaacatgaccgcagttaggacaatagcagcttttcaattcataattagtttttttgaaatcatcatctttaataataagttctaaatagctaagtgtagaaatgccattatccttaataaagcagttagttttaagcgtggtttgacaaaccgggcacacttttttcatactgtcacctctttaatttattgtatcataaaattgcgatataataatagtatttgtgcctttattcgataaagtatgctataatatgcgtggagtaaaatcggactctaggaaaattgaatataataaaattgaatatatataaatacaataatagaaaggggttagtcgaatacggcaataaatatgataaaacttacaaatgtaacgaaaatctataaaactggtgtaagagctttaaatgatatgaatcttacgattgaaccaggtgaatttgtttatgttattggtactactggtgctggtaaatcaacatttataaagcttttatatcgcgaagaaaaagcaacttcagggaaagtagaggttgtagggcgcgatgtatcaaaaattaaaaatcgaaaagttccttattttcgtcgtaatatcggggttgtatttcaaaattttagacttctaccaaaaaagacagttttcgaaaatgttgcgtttgcgttagaagtaattgatactccacgtgtagaaatccgtcgtcgcgttagagccactttagagttagtaggacttgaggataaagtcaatgcttttccacatgaactttcaggtggtcaacagcagcgtgtagcaattgctcgtgcaattgtcaacaaaccaaaagtgctaattgctgatgagccaacaggaaacttagatccagaaacatctgaagaaattattaatcttttagagagaattaatgaacaacagaatactactattctagtagttactcatgacagtaaaattgttcaagaacataaaaagagaactattttgattgaaaatggatgtgttaatgcggacactagtttaggaggttacgatatttaatgaacgagttgattagttgtatgaaaaatctgcctaaacattttaaaacggcagttcaaaatatatggcgtaatggtgtaatgtcattttcatcaattttcgctgttacgattacgcttgttttaattggtgtaattggtgttttagctttaaatgttcaagatattagttcgaacattgaagagggagttagtatttatgtaaaattagatagatatatagacgaagctgctgaacaagcagttgggccacaaatagaagctatttctggagtaaaaaagattacttattatactaaagatcaagaattagataaattaattgaaactcaaggtgatgaaggtgctgctttatttgaatcataccgagcagataacccattaggtggggcttatgaagtagaagttgatgatgcagcaaatattgctaaaatcgctgaaaagattcaagaaataccaaatgtcaataaaacaagttatggtggacaatcaacacaagatatggtaaaaactttgaaaactattcaaactggaggatcgatttttattgtcggacttgccattattgcattatttatgatcgctaatacaattaaaatcacgatcacagcgcgtcaaactgaaatcagtattatgcgtatggtcggtgctagtaactggtatatccgtattccttttatgcttgaaggaatgttgattggtctaattggatcaattatcccgattattgttttagtttatggttatggaatggtatatgattacgctaatggtgcattaatgtcagcaatgttagcactaaaaccaccaatgccatttatccgcgatttctcactagttattgctgctgtaggggctggcgttggtttggttggaagctttgtttcaattagacgattcttaaaattctaaaaacaggcagtgcctgtttttttaataggagtaggaatgatgaaaaatgagatattaaaatttcttaaacaagattatcttaataatttagatttaatatatgctcttgaacatggtgctaagataaaatattataatcaggcaggaataatgcttaaatttgaggatatctatatgcttgcattcaaagatgaaaaaattgctgaacaatcacttaaacaaatagataagtgctcaatgctagcaattcacaatgataaatattttaatataattaatcaaaaatggagattaaataaagaaattgtagcttaccagtatggctatttaaaaaaatatgttagaataattaataacccaatcgttgaaattaaagaaattgggagggaatattttgaatttattaaagaaaattattctactccgattgaagaagcatatttgcttgaacgaattgatgctaatgtatttgtgggtgcgtttattgaaaagcagattgttggatttgctgggcgtcatatagagggaacaattggttttgttgaagtaattaaagaatatcgacgtcttggaatagctcaggctctagaacagtatttaatgcaaaaactaattgctgaaaacgaaattatttatttacaagtagaagtagataattatccatcaatgcgactacatgaaaaattaggctatgagcgttctgatgatattatcacctggtatatgtaaagaaaggaaagaataatgggaaattataattttgatgacttacagtatttacaaattccgttgccagaggaattattaaaattaaaatggcatggtagttttacaagaatgaaaagaataattgatgcaaaattagctaatgatattccaatagctttaaaaaaacgactgcttcatgaaaaagaaattattcgtagaatacctcaagaatatccgttatcatatgaagaagctttaaaaatttgtcataataattttaatgattttagtgatgaggaactagaaaaattacaagatgaaaatgcggtagaatggatttttgtagaaggacaaccatactttagagctgatttttttgataacattttaaagactagaaatgattatgctgcacgtttgtttgataaaagcaaagttgaaagtcgtgaagcaaattttgcactgcttaataatgcaatacatgaaattaaaacaaagggacaattaacatatcattttcgtttaaagacgggaattaagatcaaggcatcagattcaaataaaaaaattaaaattcatcttcctttgccgttagaagattgtcaagttaagaattttaaattaattgcgacaatgccgcaatacaaatatttaaatgacggaagtcatccacagcgaactgtctattttgaagaaaatattgatcaggttaaagatttttatgtggagtatgaatatgataatgagatgaaatatgtagaacttaaacccgaagatgttttagaaagtcaacctaatttttatttacatgaacaagcaccgcatattgtttttaccccttatttaaagtctttggcaaaagaaatagttaaagacgagacaaataatttaattaaagctaaattaatatatgagtatattacaactcacataacctattcatttgttcggaattattacacaattcccaatattcctgagtatgctgctttaggtggaaaaggtgattgtggtgttcaagcactattatttattactttatgtcgttgcgtggggattcctgcccgttggcaagcaggtttatatgtaactccacaggatatcggtaatcatgattgggcaagattttatattgctccatatggctggttatatgctgattgttcttttggaggttctgcttatcgtaatggtgatcaggaacgatggcagtattattttggacaccttgatccgtttagaatgcctgcaaatagtgaatatcaatacgatctttatccaccgaaacaatttattcgtcaagatccatatgataatcaaactggtgaggctgagtttgaagatcgtgggctgtatttagatgaatacgatttacatttagaagtactagagatcaagaaagtttaattataaaagttaaaaattatagttatcaaacttttccagaatatccccaagatgttgagggaatgatcgatttatatggtgtgactaactttttaactttcaatcaaggttttagtaaatataatgaaaaagaaatgacaaatatttatgatttgttggggtgctggtgcgaggatgatgaagttctctatcgtgaagcatcaccggtatcttatcttgaagcgaaaatgaatttgctaccaattcttattctgcatggttctaaggagcatgttgttccttttgaacaatcagtagaattatatcaaaaataaaaagagtatggtcataatgcaactttatgcaaagttgctaaagctgatcatgagcgttcaattttttatgttagagcggtctttgatgttatcataattttttaaatcaatataaataaaatagcgcataaggcgctattttatttttgactttgttcttgtttttctaatagctctaaccagcgttcatttttaatctcaagttgttcatttaaatagtcacgctgatttgataattctgacaatttattataattactttgatactcattcatttgttcattaataattttgatttgttgttcaaactcaagaataaccttttccatattttcaagttcttgtttttctttaaaacttaagcgaatagcactttgaagttttttctgttctttatattttaaagctccgtcgcttttattcttattttgttgttcagaaatatcgatataactgctatagccaccattacaataagtgatttgttgattcttaaaaacgaataagccatcacaaatacgatcaagaaaataacgatcatgagatacggtaatgactatgccattaaaactatcaagataatcttcaagaatagctaaagtggaaatatctaaatcgttagttggctcatcaaacaatagtacattgggagcttgcatcaaaatattcaacaaatatagacgacgtttttctccacctgataaacgagcaatataagtatgttgtaaacttgaatcaaaaaggaaacgttcacacatttgtttagcagtaaagctgccttcaagggtttttaaatcattacttgtttgtttgatatagtcaatcacgcgcatattttcatcaagaccatcattcatctgtttaaaatatccgattttaattgtatctccatgagtaactgatccactgcttggttctaactctttagcgataatctttagaagggtgcttttaccacaaccatttattccgaggattccaattcgatctgttcgtttaaataagtaagaaaagttgttaaacaaggtatgatcatcgtagcacatactcaaatctttcaactcaattgtctttttaccaagtctagaagcagtattgattaattctacttgattaatagtttgaatatcagaaatattgttgagctgttcaaatcgttgaagtctctctttgcttttagtagttctagcctgaactccagctctaacccactctaattctttttttaagaataattttctttttctttgggaagctagatcagcttcttcgcgttgtgcttttaaatcaaggaattttgaatagttagcagtgtattcataaattttgctacgatcaatttccatgatcttattggtaactcgttcaagaaaataacgatcatgggtaaccattagaatggctttgttgaacttaattaaatatttttctaaatattcaatcatttcgttatctagatgattagttggttcatcgagaattaagagatcacatggttttagcaaggtgattgcaagggcaatacgcttttgctgaccacctgataattctttaattaactgttcataattagtaattccaaacttatttaaaattgctttgatttcatattcattaacttcgctggcatcaattaatttataaacttgtttaataacgctgttattaggatcaaaatcagggttttgtggtaagtatgagattgtcatatctttttttctaataatatctccctgataattttcatttccagcaatgactttcaacaaggtacttttccccgtaccattaactccaatcaaagcaactttatcggtttcttcaattgaaaaagtaacattatcaacaatatttttaataccattcgtttttgataaattatttgcacttattaacatatacgtctccttaaaccttcttctattctatcatggaatagaaatttgtaaacgaaatattatcatctcaattaccaaaaaaccttattcttggtataatgtttatgggtgatttaaatgaaacgttatacaatagggaaaatggcaaaattaaataacgtaactgaacaaaccctaagattatatgacaaaatgggtttatttaaaccagcttatgtagatgaacataacggatatcgactctatgatattggtcagtctgcacgacttgacataattcagtatttaaagaatttgggaatgactttaaaagaaatcaaagaaatttttgattcaaaaaatttagaattattacaggaaaaactagaagaaagtaagctacagattaacaatcaaattattcaattaaatgagcaaaaagcagcaattcaaaaaacaattgattcatttgaactttttaaagctgccccaaaagttggaatgatcacattagaatttataaataaaagaacgatgctctatgttgatgaaaaagtaaatttttatgattatgatctagatgtttatgaagaattattaagggaatttaaagatgatctcattaaacaagctttacctccaacaatcttttttaatccaggaactattttgcgtaaggaatatgttttgaaaagaaaattttgtgcaactgaaatttttgtttttattgatgataaaaaagaaattccgttaaaaaaagaaacaattccagctaatatgtatctatgtatttattgtgatgattttactaaagaaaaggaatatgcacatcgtctttttgatgaaattgaatctaaaaattatacaatagtcggggattatctatgcgaaagtttgaatgatattttgatatttaacgataaacaaagaaatatgtatttaaggttacaagttccaataaaaatttgataattatttcacaaattcttgaccttatggtaacaataaagtttatacttagagtatatggaggtaatcaagatgaataaagaaaaaattagagttgtacagtatggatgcggaaaaatggcaaaatatataatccgttatctatatgaaaaaggtgctgatattgttggtgctatcgatgtaaatcctgatgttgtaggcaaggatattggtgaatttgcagaattaggatttaatctaggggtaacgatcagtgatgatgcagatgctgtgttagatgaatgtgatccagatattgcagtagtcacattatttagttttatggaagattgctatcctcattttgaaaaatgtgttcgccgtggaataaatgttgtaacaacatgtgaagaggcaatttatccatggactacttcatcaaaacttactaataaattagatgaattagctaaagaaacagggtgcacaatcgttggttcaggaatgcaggatatatactggatcaatatgattggaacagttgctgctggatgtcaacgtattgataaaattgagggtgcagtttcttataatgttgaagattatggtttagcacttgctaaagctcatggagctggatttagtcctgaacaatttgaaaaagaacttgctcatcctgagacattagaaccagcttatgtatggaattcaaatgaagcgttgtgcaataaaatgggatggacaatcaaatcgcaaacacaaaaatgtgtaccatatttttatgatactgatttatattcagaaacattgggtgaaacaattccgaaaggaaattgtatcggaatgtctgcggtagttacaacagaaactttccaaggaccaatcattgaaactcaatgtattggtaaagtctatggacctgatgatggtgatatgtgcgactggaaaattaaaggtgaacctgatgtaagtttctatgttcaaaaacctgcgacagttgaacatacatgtgcaaccgtagttaatcgtatcccatctattttattagcgccaccaggatatatgacagttgaaaaattagatgaattagaatatctatcatatccaatgcatttgtattgtgatgaataagaatcctttgggattctttttttagttaactatattgattatcaacatagttagtgtataataaaagtaagaagagtatcgataatcgatataagggtggtaaaaatggcaagaaaagagtttgagacactcacgcctcaaatgttctatattttagtagtattgaatgttcctcgacacggctatgaaattatgaatgaaattatgcgaattacaaatgatgagataagggtaggagcaggaactttatatactctcttatcgcggtttcaaaatgatggttatattgaattagtaagtgagattgatcgaaaaaaaatttaccagattacaaaaataggtaaatataaactgcaagaggaaaagcggaaactggaaatgcagataaaagctttgaatgaggtaaatcaagataaaaattaaaataaaaagatatgatatgctgtttatagatgaggaggaatatctaagtcaattaaatttattaggcaagaaatggctggattttaagaactattaaattttatttttgtaagggaaaaatctcagaatttaaaatatcaagttgattatcacctgcatagtgatgaatataaagatttgataactggtatatgtttatagatatttataaatgtatcacaatttttataccgaagatttagcggtagttgatttgcgtattgatattggcaattgttaatttatttaatggctttttttaataaaaattacatggggaaattttattttaaattatggaaagtgggagaacatagtgaaggttaaatatagattgctcaatgatttgttactttatgaagatgaatgtattacctatttagaaaaaatggcacaagatggctggtatttagtgaaagtgggaacaactttttttaaatttgaacggcggtcgcccagaaaagttaaatatcaaatggattataatcttttaacacctgattatcttgaaatgatcactttagaaggctatcgctttgttgacaattatagagaaatttcattcttttataatgaagatattaatgcagcgaatctacatacagatgaagcagcaaggctaatggcattaggcaacatatataaatatttccatgtttttttaataattggatgtgcattaatattattgattataaactcaagtatatggaaaatgaatttattggtaattcgatatactcttggcagtttctttcttaatacaaagctgtttttcggtcattatttatatatctttatagctttaatgtttgttatcgatggtattgcactattcttgatgaagctaagtatcaatcgccaacaagaaaataaaaaatcgttaaaaaaatggataaaactatgttttataattgaaaagttaattgggctgattctattatttatcttaactttagtgataattgatattgtagtatataacccgtttgttttgatcggcctgataatagtaattggtggttttgaaatatataattattatatcaataagaaagcttaccatgaaattaatagtacacttagacgagggaagactgctgttgcaatggtattagttgtagtatttgtgattgcaatgcaaaatattgattttgatattaatattaaaactattcagcctttacaaaagggaataaacgttgagagcacttcaacgcggtcgattttagttagtaattatgttaatacttcttatgaaggagagcaattgatttttttagaaagtaaatatgaatgtttaaataattatattgcaaataaggtatttgaagaaatagtttgtggcgtggagcgagatagcaggattcctgatgaaacagaaattgatgcaattgttgaaacgacaggggaatggtctactaatgatgtaaaatatttaaattatttacaagcgataaaaaaatttaagtatattcaaactgagtatgctgataaatgctattattttgataatacatttgtagcaattaaaaataaacaaatattattaatagtaaaaaaagaagataccaaaatcgatgagattctaaagtactatttatcttaaaatgattcattacttcaaacagttgttgataaagttattgattgaaaaagtgatgataaaatttccagataattctttttaataaataaaaaagtggcttaattagccacttatttgtttactggcagaggtagtaggagtcgaacccacatcaacggttttggagaccggtattctaccattgaactatacctctatttccaactgccaattaataataacataattgtaaaatcttgtaaataaaaaattaataaatattataaataagttttttgtgatgttaacctatacgaattatttcaatattcataatttagagtagaaggaggaatttaatgaataaattagagttaggtatttcatcaataaaatgccaagaatttagaaagatatatccaattgttaaagcttttcactctggaactatctttgaagagttagatttgccatggggtgagttatgccgatgaaaaatgatgatctattaatgcaaatcatgatgttggattttgcagtgcaagattctgcattatttattgatactcatccctgtgataaagaagcgatgaattattttaatgaggcagcaacacgtttaaaagcagcaaaaaaagaatatcaaaaacaaggtcatgctttagtaaatcgagaagttggagcttaccaaaacgattacttatctgcaccttggccatgggtaggtgatcataaatgtggttgtacgaaaaacgtttgcaataccctataaacattactaaaccgaatgcaaaagcagcggcagttattattgaccaattaggcggacctgatggagagcttggagcggcacttagatatttatctcaacgctatacaatgccatatccagaaattcaagcgttattgacagatattggtactgaagaattagcccatgttgaaatgatcagtgccattttatatcaattaactacagatttaacaattgatcaaataaaagcacaaggttatgataaatattttgttgatcatactttgggaatttatccacaaggtgcaagtaatgtaccttttacagcggcctatttccaatctaaaggcgatccaattactgatttaacggaggacatggcggcagagcaaaaagcacgtacaacttatgataacattttagctcttgttgatgacgaggaaataaaaaaaccgattcgtttcttaagagaacgtgaaattattcattatcaaagatttgctgaagcgttggagatcgttaaagggcatttaaacagtgataattactatgcctataatccagcatttagaaatggtaaatgcaataaaaagtaaattaaaacaatacaatgagatacttcattgtattgtttttttaagtgtgccgtgcatggcatacatctagttggtgaaagtccaaccacgggtatttaccgccaagtatagtgaaccgcaagtcattaacagcgatgttatgggtgaaagaagtagtgtaacaaaatcttcgaggttacgaatagaaatttaatgaagctaaacaaggcatgtcgatgcgggtttagtgaagaagaaatatataaatgtgtgaatacaagattaggatggtatagaagaagtgcgatgaatgtcgtaaattttacaatatcatcaaaagttttaggtataaagaaaagagacaaactaggtttagtcaatcccctcgattactatcttaagagtttgtgatagcgatataaatgtagagccgtatacgagacccgtacatacggttcaatgggagggacaatagatcactgaatttattcttctatcctattatttgttcgattttcgttgtaataaattcagttgggcaaaggattttattagctcggctttttttacatcattaaaatattgatattgattttagatgggagatttaaattattttttgttatggaaaataaataatgatgaagatagatactaagattgttataattagcttgatttgaacaatcttatgataaattatattgatttaatcattgctttatgacataataatgtgacttagtaaaaaggagtttaattaatgatatctacacaaaatgtatctttacaatatggtgatcgtgccttgtttgaaaatgtaagtgttaaattcactgatggtaattgttatggaatcatcggtgctaatggagctggtaagagtacttttttaaaaattttagctggagaaattgagcctaataaaggtgaagtaattttagaaccacataaacgtttatcggtcttgaagcaagatcattttgcttatgatgaaaatggtgttgtagaaactgttatcatgggtaataaacgtctttatgaaattatgcaagaaaaagaagtattatattctaaacctgatttcaatgatgaagacggaatcaagttagctgaacttgaaggtgaattcgcagaaatggatggatggaatgccgaagtagatgcagaaatcatgcttaatggtttagggattggtgaagagttacataatttaaaaatgaaagaattagatggaaaccaaaaagtaaaagttttgcttgctcaggcattatttgggaatcctgatgttttattattagatgaaccaactaaccaccttgatctagacagtattcgctggttagaaaacttcttattgaattttaaaaatactgttattgttgtcagccatgaccgttatttcttaaacaaagtttgtacacatattgctgatattgattactcgcgaattcaattatatgttggtaattacgatttttggtatgaatatagccaattacaattacaacaagctaaagaagtaaataaaaaggcagaagctaagaaaaaagaattggaagaattcattgcgcggttcagtgctaatgcttctaaagctaagcaggcaacttcaagaaaaaaattattagataacttagaaatggttgatattaagccttctcttcgtcgttatccgtttatcgcttttaaaccaggtcgagaagttggaaatattgttttaaaagtagaaggattatcaaaaacagttgatggtattaaattattaaataatgttagtttctcaattaatcctaaagaaaaagtagctttcgtcggcgatgttaaagcaacagagacattctttaaaatcattatgggtgaaattgaaccggatgaaggaactttccaatggggagtaacgacgtcacaatcatattttcctaaagataattccgagttttttaataactgtgatttaactttagtagactggttgcgtcaattctcggttaaagatgaatatgagcaagatcttcggggctggctaggaagaatgttgttttctggtgaagaagcgctaaaaaaagcttcggtattatcaggaggcgaaaaggttcgttgtatgctggctaagatgatgatggccgaagctaatgttttagttttagatgaaccaactaatcaccttgatttggaatcaattcaagccctaaaccaaggacttattaattttaaggagaatattttatttaccagccatgaccatcagtttgttcaaacaattgctgatcgaattattgaatttaatgaaaatggtattttagatcgtttatcaacatatgatgaatatttagaatataaagaaaataacaagtagatactaggtatctacttttcttttgtgtataatatagacaatagggatttcaggaggaaaattatgaataatacaattaagcagttatttgagcgtaaatcggttcgtgtatatcaagataaaccaattgaggctaaagaaaaacaattaatttttaatgcagccattcaggctccgactgcagggaatatgacattatattcgattattgatatacaagatcaggctattaaagaaaaattagcgaagacgtgtgataatcagccgtttattgcaaaagcacccctagttttaatctttgttgctgattatcaaaaatggtatgatgcatttaaatattatcatggtgaagaacagatgcgttcgccatcatatggtgattttttattagcatttagtgatactttgattgcagctcaaaatgccgttgttgcagctgaaagtttaggaataggaagttgttttatcggtgatatcattgagcagtatgaagtacatcgtgaattattaaatttacctcaatatacagctccagtggggatgcttgtaatgggttatccgacagaacagcagcaacatcgaactaagcctgctcgttttgattctaaatatgttgttagtgttgatcgttatgaaaaatttgatgatgaaaagttagtaaaaatgtttgatgatcgagcagttttagctaatcgcagcagtgggggacgaagttttgtcgatgatatttataatcgcaaatggactgatccatttattgaagaaatgtctcgttcatctaaattatggattgaacaatggggaaaagaggatgaagaaagctaagatgattcttagctttttatcgtttatcagctcttataaagatgataaataattattgaaagatagttgacatttgctaatatttgcatataatatatagcgtgctatttattttggaggtggtaaaatgccaaataaaaaaattggatttttaatcaaacaagttttttatttacatgaacagcatttaaataaacaatttagtaaatttggattaactgcttcacagacatttacattaatttatttgtttaaatctcacgacaaaggaattagtgtgaatcaaaaagatattgaaaaagaattagatatttctaatcctacagttactggaattttgaatcgtttagaagtaaagggattaattacccgggtaccgtgtcgtcatgatgctcgtgctaaaaatattgaagtaactgaaaaggccttagaactggataaacagctacggattgttttccaacagtctgatgaaaaattagttgaatcattatcaaaagaagaaatagacaatttacaaagttatttgattaagatattaagaagtaattcttaatatttattttactgttattcatagcacgctatttaatttttagggaggtatataaatgttaaaaacacttttagcccaaataaaagagtataaaaaagatacgatcttaacacctgtacttgttgtggttgaagttattttggaagttgtaattccacttttaatggcgatgatcattgataagggaatagaagttagagatatgaatatggttgttaaattaggaatcattacattgctcgcttcctttatttctttagcggcaggaggtttggctggtaaatatgccgctaaggcctcaacaggttttgctaaaaatctaagaaaggcaatgtattacaatattcaagatttttcttttgctaatattgataaatattcaactgctggattggttacaagaatgatgacggatgttactaatgtccaaaatgcttttcaaatgttaataagagcttgtatccgtgccccattgatgatggttagtgccatgatcatggcttttacgatcaatgctcagattgctatggtttttttagtggcaattatctttttaggagttcttttagttttctttatgactagagctcatccgtattttaaaagagtattcaacacatatgatgatttaaacgcttcagttcaagaaaatgttaatggaattcgggttgttaaagcttatgttcgtgaagaacatgaagacgagaaatttaaaaagacatcaactttgatttataaactatttgtaaaggcagaaaactatttagtttttaatatgccgctaatgcagttaactgtatatggatgtattattggaatttcttggtttggagcacacttaattgtcgggggaaatcttactactggagaattaactagtttatttacctatgtaatgatgattttaatgagtttaatgatgttttcaatggtatttgtcatggtagttatgtcaattgcttcagcccaacgtattagtgaagtaatcaatgaaaaatcaacgctgcataatcctgctgagcctgattatgaaattaaagatggttcaattgattttaataatgttaatttctcatattttgatgatcaagaagaaattaatttacgtgatatcaatgttcatattaaatctggacaaacaatcgggattattggtggaaccggtagtgctaaatcaacttttgttcagcttattccacggttatatgatgtaactaaaggagaagttttagttggcggtaaagatgttagaaaatacgatttggaaacattgcgaaatgaagttgcaatggtattacaaaaaaatgttttgttttctggaacaattaaagaaaacttacgctggggtaataaagaagctagtgatgaagaaattgtggaggcttgtaaattagctcaggcagatgagtttattcaacgtttcccagataaatatgatacctatatagaacaaggcggaactaatgtttctggagggcaaaagcaaagattgtgtattgctcgtgcattgctaaagaaacccaaaattttaattttagatgattcaactagtgcagttgatactaaaacagatgcattgattcgtagtgcgtttaaaaaagttatccctggaacaacaaaattaattattgctcaaagaattagttcagttgaagatgctgatttaatcattgttttagatgatggtcagatcagtgctatgggtactaatgatgaactattggagtctagtgcaatttataaagaaatttatgaaacacaaaagaagggaggaactttaagtgagtaatagtcggggaaaaacaatgaaaagattgtttaaatttgttgttaaaagacataaaaagacctgctttgcaatattgttattaatcattgttagtagtattgctagtgttatgggaacaatctttatcaaaagcttaatcgatgattatattacaccatatattaatatggcaaatcctgattttggaccgttgacgaatgcgattttgaaaatgattgcaatttatgcagtaggagtaattgctacttttagttataataagctcttaattaaagtgactcagggatcgttaaaagaaattcgtgatacgatgtttgaacatatggaaaaattaccgattcgttattttgatactcataaccatggggatatcatgtcaatctatactaatgatactgatactttaagacagatgatttcgcaaagtgtacctcaggttattgtttcagcaacaacgatcgtttgtgttcttgtttcaatgattgtaatgtctattccaatgacgataattagtgttttgatggtttgtgtaatgttattagtttctaaacatgtaactaatcgtagtgggcggtatttctttgctcaacaaactaatttaggtaaagttaatggttttattgaagaaatgatggaaggacaaaaagttgttaaagtcttcactcatgaagaagaagctaaatttgattttgataaagtcaatgaagaattatttgaaagtgcatatcaagcaaataaatatgctaatattttaatgccgttaattggaaacttaggatacgtaagttatgtgttagttgcggttgtaggtggtgttcttgcgattaatggctatatggatttaacggtagggacattagctgcctttctacaattaaaccgctcttttaatcagccaattggacaaatttctcaacaaataaatatggtgttgatggcattggcaggtgcagaaagaatctttgcattaatggatgaagaggttgaagatgatcttggtcatgtttctttagttaatgctaaagaaaatgctgatggtacattatctccagttaaagaacgtactggactttgggcttgggagcataagcgaccagacggttcaatcgaatatgtccgtttagctggtgatgttcgttttcatgatgttacatttggatataatgaaaataaaacaattttgtatgatatgaatttatttgctaaacctggtgaaaagcttgcttttgttggagctacaggagctggtaaaacaactattacgaatttgatcaaccgtttttatgatattcaaaaaggttcaataacttatgatggaattgatattaaattaattaaaaaggcagatttgagaagatcgttaggaattgttttgcaagatacacatttatttactggtacagtaatggataatattcgttatggtaaacttgatgctactgatgaggagtgtatagaagctgcaaaactagccaatgctcatgaatttattatgcatttagaacatgggtatcaaactattttgagtggtgatggttcaagtttatcacaaggacaatgtcagctgctagctattgctcgggctgcggttgctaatccaccggtattgatcttagatgaagcaacatcaagtattgatacgagaacagaaagtattgttcaaagtggaatggataaactgatggaaggacgaacggtttttgttattgctcatcgtttatcaacaattaaaaattctgatgccatcatggtacttgatcaaggaaggatcattgaacgtggtgaccatgataaattgattaaagaaaaaggaacttattatcagttatacactggtggcttagaattagattaaaaaagcagctcgatttgagctgcttttttatgcatgtttgacccgatctttttcttcagcagctttagcatcattgaaccgatctaaagtacctactaaatatccagtgattcgacggattctttcaaaacccaaaggataaaaagtataatctaaatcaacctcatcaccgtcaattttaattgataatgatttaagtgtttcatcaggaaactttttttctaagtatttgatataagcaattatttcttcttcgtccatttcaccgtttttaacttcaactgcaacgttattaatgtcttccatggttatcacctcaatatcattataacggtttctatttttactagcattaaatatgcactattaccaccaataacaaattatcatgaaaataagagttgaaagaataatagttaatacgcgattaactcgtttaaacatgtatctcatactatcaccattataatatatgtttgatttattaatatttaacatgaaataatatgacaaatgttaattccttattgagaagataactgttataatgacgctggtgataaaatgaaaaagaaaaaattaattttatttgacatggatggaacattaattgactggcgccagggaatcgataagccaactaaacaaatgtttgaagcttttcaaaaattacgcgaacatggttttttagtaatgattgcttcaggacgattgttacctttgatcacagtacctcttcgaggatttgaatttgatggatatcttttaagtgatggagcgcatgttattttaaatggtgaagagattattaaagagcctttagatcatggtgatgttgaacgaactatttcattagcacgatcattaactttagagtatggtttattgtttaaagatggggcttatttacaaaaagatggggtaattgcaccatttctaaaaaagctaactttgatatgaacaaaattaattatgaaaaatatgatgatcaggtatttaaattatatattcattgtcaaaagaaaaaacaaaatgagattattgaacaatttggctgttttaatttagcttttgaggatgattatgatctgattgaaattagaaataagtaccattctaaagcaagtgggctaaagtcaattttaacacgcttagaaattgaaacagaaaacacatatttttttggtgatggatttaatgatgtggaaatttttaatatggtggggcattcttatgtgatggaaaatgcggctcctgaactatatcaatatgggacaatttgtcagccggttgaagctgatggagcgtatttgaaagtaatggaaatattggctgaagagaacctttaaaatgtgcaaaggttcttttttaaataaatataatcttggaattgaaaaatattagtcaatttgataaaatcttgtaaatacatgaaaaggaggggaattatgcagctgcattttacaaaaatggaaggcattggtaatgattatatttactttgatggaataaatcaggagattcccatggataaagaatttatcatgaaaataagtgatcgtcatttcggtattggaagtgatggaatgatcgtgattttaccatcggatcagtatgattttaaaatgcgaatgtttaatctagatggaagtgaagcaatgatgtgtggaaatggaatccgctgttttgctaaatttatctatgatcataaattgagtgataaacatgtattgaaaattgaaactaaatcaggattacgaacagtagaattattatttgatggcgatgagtgtattggagcaaaggttaatatgggcaaacccgtcctaacttgtcaagatattccttgtacatatgctaaagagaaaatgattgatgaaccggtagaaattggtgggcgagaataccgtttaactactatttcaatggggaatcctcatactgtgacttttgtttctgatttagatactttggatttaaaaacaataggtcctaaatttgagcaccatcaattgtttcctgcgtctgttaatactgaatttgttcaaatcattaacaaaagttatgttaagatgcgtgtttgggaacgcggttcgggtgaaactatggcttgtggtactggtgcttgtgcagttatgtatgcatgctatttaaatcattatacggatagtaaggtaacagtggaattattaggtggttgtttggaaattgaatatgtagatgaaacgatcatgatgtctggacctgcaacaaatgtttttaatggaacaatagagatatagaaaaggagatagatatgttaaatagtgcagaagagataattaaatatattggtgatgctaaaaaacaaacaccggtaaaagtttatttaaaagggaaaaacttaccagaagcaactgaatttaaaatgtttggtggagaagatagtaaagtatgtattggtgatttagaggctattaaagcttatatggaggtaaataaagaggttattgttgattcttatttagaacaagatcgtcgtaatagtgcaattccaatgttagatatgactaatattaatgctcgtattgaacctggatgttttattcgcgaacatgtaacgattggcgataatgctgtaattatgatgggtgcagttataaatattggagtcaagattggtgaaggaactatgatcgatatgggagctgttttaggtggtcgtgtagaagttgggaaacgttgtcatgttggtgctggagcagttttagctggagttattgaaccacctagtgcttcaccagtaatattagaagatgatgtattgattggagctaatgctgtagttattgaaggagtacacattggtaaaggtgcagttgttggtgctggttcgattgttacaagtgatgttccggcaggggctgtggtagttggaaatccagctcgaattattaaagaacaaaaagatgaaacaactgaaggtaaaactcagttaatggatgatttaagaaaaatttaggagatcagttatggacgctttaaatgaaattaaaagatggcgtcaggaattacatcaaatccctgagctaggtttacaagaatttaagacttcaaaatatcttaaagatgaattaactaagatgggatatgaaccaatttcaatcttggatacaggggttcttgtttatcttgataatcatcaagataaaaccttggcttttcgtagtgatatggatgcattgaaaatatccgaacaaactaattgtagttttaaatcatgtcataatggttatatgcacgcatgtggtcatgatggtcatatggctgctttacttggattagctaaaaaactaaaagagcagcctttaaagtggaagcataatatcttattgatatttcagccggcagaagaatcaccaggtggtgcaaagttaattgttgaagctgggattttaaagcagtataatgtaagagcaatatttggtttacatttaatgccgacaatcgaagcaggaaagattgcttgtcgaccgggaccattgatggctcaaaatggtgaacttgatgtgacaataactggcaaaagtgctcatgcagggttatatcatttaggaattgattcaatcatgattgctagtcaaataatttgtcaatatcaaagtattatttctcgagtaatagcacctgttgaaagctgcgtaattaatattggagaaattcaggggggaactgtgcgaaatatcgttgctgatcaaacaacttttaaaggaacagttagaacttacagcgagacagtttttaaaaaaattacagatacgatggaggcaattaatcatgggatggagcaaacctatggctgtaccattgaatttagttgcccgccaatgtatccaccggttttaaatgattatgatctatatcggcaatttgttagattaactgatgagaattatgaggaattaaaagagccgttaatgttagctgaagatttttctttctatcaaaaagaggtaccaggaatattcttttatgtaggaactaaaacaccaaaatattttagcggtttacacacagaaacatttaattttgatgaagaagtcttgatgcaggcagtagaattatattatcgtctagcagataagattaaattgggggactaaaaatggattattttgatagagctaataatgcttttatgaaagcttatggtagatttgatgttacttttgatcacggtaatggagtttatttatatgatacaaacggtaaaaagtatttggatttttattctggaataggtgttaattcatttggctatgattatcagctgtatacagatgcaatgtgtcaacagatgcaccgtttaatgcacatatcaaattattttaatagtgttgaaacaattgaggctgctgaagcggtaattaaagcaacacaacttgatcaagtattttttactaatagtgggacagaagcgaccgaaggggcgttgaagttagcgcgtaaatattattatgaaaaacatggaaaggctgatagtgaaattattagtttgaatcattcttttcatggacgttctacaggagcggttacattaacaggaactcctgcatatcaaactgcatttggaccattaattacgggtgtaaaatatggcgatattaatgatttggattcagtggctaagttaatcaccccaagaacagctgcgattattttagaacctgttcaaggggaaggggggatccatgtttgcacccaagaatttatgaagggaattcgacaattatgtgataagcatgagattgtaatgattcttgatgaagttcaatgtgggatgggacgaacaggaacgatcatgacatatttccaatatggaatcatgcctgatattgtttgtctagctaaaggaattggggctggtttcccaatgggagcgtttgtagcaaataaaaaaatcggagatgctttaaaacctggtgatcatggatctacttatggtggtaaccctatggctggaaaagcttgtaagacagtctttaagattttagaagaaacgcaaatgcttgatcatgttcaagatgtcagtgaatatttgattactaaattagatgaactagttgaaaaatatgattttattaaggaacgtcgcggtttaggactaatgcttggcttagaatttgatcatccagtcaaaccatatattcaaaaagctctcgataaaggtctagtgttgattactgcgggaacaaatgtaattagaatgttgccgccattcatcattgaagaaaaagatgttgatgagatgattagtatatttactgaagttattgatgaaattaatagttaatctttacttttaaaagatagaaaaaaggaattgtttaagataacattgcaatagtaatgttatcttttgttttacatcatcataatttagcactatactatagggaaggtgatatgatgaaaaaaggaatgttgttgaagctttttgtaacaaatctttatttaagtgcttttacatttggcggtggctatgtaattgtgacattgatgaagaaaaaatatgttgatgagttcaactggatcgatgaaaaagaaatgcttgacttgattgccattgcccaatctgccccaggggcaattgcggtaaatggtgcaattgtagttggttttaaattagcgggaatcaaaggtgcgatagtttctattttagcgacgattttgccaccgtttgtaattttatcattagtgtcagtgttttatgaaatttttaaaagcaatgagataattgccttaatgctttctggaatgcaggctggagttggggcagtaattgcttcagttgcttatgatatggcagtaggggttgttaaagaaaaagaaatcttaccaattataattatggtatgtgcttttattgcaacatatctttttaatgtaaatgttatttacgtaatcttaagttgtggatttattggaattatacaaaatatggtaagcagatggagggaaagacaatgaaacttttaactttgtttttcagttttcttcaaattggtgcatttagttttggaggaggatatgctgctttaccgctgattcagcatcaagtagttgatttatatcattggttgacgatgaatgagttaacagatttaataacgatatcccagatgacacctggaccgattgcaattaatgcggcaacatttgttggattaaagatagatagtttttatggggctatagtagcgacattgggatgcattttaccttcatgtattattgtatcgctgattgcttatatttatttaaaatatcagcaaatgtcaattattcaaaatattttaaaatatattcgtccggctgtagtgtcgctgattgcagtttcaggactattgattattgttagctgtttttttggagatacagtaaactttgcaaatttgaaatttggttctgtagccatatttatagttgctctggttttattaaggaaacagaaaatgaacccgattacagtgatggtaatagctggaatcatacagattggtttatattatataggaattagttaaggtagagagagtttttctttttgcctttttcttttcaatcccagatatttcggtgtataattaaaattaaggaggataatggtaatgtacaagcgaatactagtggtagtcactgtattatcatgtcttcttactggatgttcaagtgataataacagtaatcaagaatacccaagtgattatccaacatcaaaaagttatacagttgatgagattctttatcctgaagcatcaggggcactggttttagatagtgatgtagcgaaggttgattattctaatactaatcaaggatatgtaatggcctttttaaaaccaggtgttagtaaacgaataaaaattcaaattagtaaagatgaacaaaaactaaattatgatttaacggatgaacaaggagtgagttatccactccagttgggaaatggaaaatatttgattaaaattttagaaaatattgagggtacccaatatgcaataaaaaaaagtgtggaagttgatgttattttagataacgaactgctcccctttttatatcctaatatcttggttaattataaaccgggtgatgcgattacgacgttagctattgatgaagtgaaggatgaagataatgatttaaaacgaataaaaaaagtctatgaatttgtggctaattacataaactatgacgatgataaagtagctttagcaaaacagcagtatttgattccaaatttagatgaaataattaacaataaaaagggcatatgttttgattatgcttcaatgatgacggcaatgttaagaatcaatcatattccagcccgactgatttgtggggggactgataaagatgaatatcattcttggttagaagtttatgttaaagggcagggttgggtcaatccggatatttttatggataaagatacatggacgattatggatccgactttcgcaagcactaagtatgattatgagggaaaatacgttgaaacagcacgttattaaggagaaaaacgatgaaattgacgatgagtgaaaaatatatgttttgtaaccagatggcaatgatcttagaatcgggatttagtcttaatcaaggggttacgatggtatatgaagaaatggatgataaaaacattaaaggggttcttcaagaagttgctaaatatttagatgaacaagtaagttttagtgaagcaatcgatctaactaaagcttttgatgactatatggttaatttagtcaaagtgggtgaaacgagcggtaatttagatgatgttatgcaatcattaagtgaatattatgctcgaattgatgatataacaaataaactgaaacaggctttaacttatccaatcattttaattattatgatggtggtggttgtaggaatcattgtatttaaagtattaccaatttttaaagatgttttaaatggactaggcagtgatttatcatcgtatgctaatagttttatggaatttggtcaaattttttcattgatatgttttgcggtcttgttagtgctggtgatagtaattattgctggatatttatatcagcgcgttacccatgtaaatgtcttgtcaaacgtagtgcagaaatcttttttaacaaggaaattgtcaagagcattaaataaagctcaaattacttatgctttgtcattgtttatttctagtggttatgatttacaagaggcaatgaagtttgtaccaaaattagttgatgataaacagcttagggctaatttagaaaaatgcaatgaagatctcataaatggtgatagtttcgttgaagttatcaaaaaatatcaaatttatcaaggaatgcagttaaatatgattcaggtcggttttaaaactggacaggttgatataatcatgaaacaattatcaaatagttttcaagaagaagttagtcgtgcgatagatcaatttttaaatatcatagaaccaacgattgtaactttgttatctttagtagtgggaacagtcttgatgtcggtaatgttgccattaattagtatcatgtcctctttataggaggttatttatgaaaaatatgttaaagataatcttactgatagttataatcatggtaagcatttatgctttcaattctacttcaacatattcatcaaatgaggatctaaaacgggttagtgatacaattaatcaacttagtttaaaatgttatagtattgaaggcaaatatcctaaagatattgagtatttgaaggaaaattatgggttgcttttaaatgatgaagattatcaggttatttattattatgaaggagataatttacaaccacgaatcgaggtatttaaaaaggagaagaactatgaataaacatcgtaatatacatgtattattttcgctgtcattgttcttgctttttgtaattgggtctttctttattgttacttatgaaataaaaggatatcaagttattaatgatacgtgtcaacaagaagatgatttaattgtgcctttggcttatttaaacacgaagttaaaagcaaatgatagtgacgattcgactaaaattgttgaaatagataatacgcaatgtttagaaattaaaactgctaagacggttacttatatttattgtcaagatggttatctcaaggaattatatacaagtaatgactatcatgcggggttacaagagggtagtaagttatttgcattagatgattttaaaatagaacaaaaagaccgtttatttaaatttacagttacacgtgatcaagttagcaaaagtatttcaatttatttacatggataggaggaaagtatgaaatcaaaagtacagtcattttcgtttttaatggaattaatcatagttatcctcttttttgctgcttcaacaacagtatgtgcctcatttatagtgcaagctaaaaataaacaagtacaagggactaatttgcaaaatgcattaattgaggcgcaaagtatgattgaaacaatgcaagcttatccgcaggctgatttagaacaattattggaagtagaaaaaatcgatgagaatcattatcaaaaagataatatttttattgaaatagatagagatatgattactcaaggaaaaataatgataaagaataaaaacgaagttatcagtgaattgccttttgtattaggaggtaatcacgatgaataagaaacatacttcaatgcgtttgggaattggggcgccatcaatttttatgatttttgtgattttagttatgtgtgtactggcaatattatcatatttgcgagctaattcttattatgagtcaagcgttcgccaagctaatattactagtcaatattacgaaagtgagtcacggctgttaaccaaatattatcaattagatagtcaaaatttagaatatagtttagaaaatcttcaaatcgagtatcaaaaagaagatgatttatatatgcttgaagataaaataaatgattctcaagttttacagctgtcatttgtgcaagaaaatgatagtctcaaaataattagtttaaaaacaattaatctggaggaataaaatggaaataaaaaaattattagaagaagtagtaactaaaggggcttctgatatctttattgttgcaggttcgccttgtgctattaagatagatgggagaatttcaaaatatagcgatgaacgtttgacaccacatgatactgagcggatgattcgtgatatttatgaaattgctaataacgctggaattgaagaatttatgagaagtggcgatgatgatttttctttttctattcctaatgtagggcggtttcgggtcaatgcttatcgtcaaagaaactcttgtgccgcagtattacgtgttgttagttttcaacttcctgatcctgaagtaatgcatattccaaaagtaattactgacctagctaatcaaaagaaaggaatggtcttagtaaccggcccggcaggaagcggtaaatctacgacattagcctgtattattgatcagatcaatcgtaatcgaaatacacacattattacaattgaagatcctattgaatatttgcatagtcatgacaaaagtatcgtttcacaacgagaagtttatcacgatacccatgactatgtttctgcgttaagagcagctttacgggaggcgccagaagttattttagttggtgaaatgcgtgacttagaaactattgatattgcagttacggcagctgagacggggcatttggttttttcaagtttgcatacagttggtgctgctaatacgattgatcgaatgattgatgtgtttcctccttcacagcagcagcaaattcgagttcagctggcaatggtacttaatgcagtcatctcccaacaattagtaccaggtattgatggtaaaatgatacccgtatttgaaatcatgatttgtaatcaagcaattagaacattgattcgtgatggtaaaacgcaccaaattgataatgctatatctactaatcgccaaattggtatggttactatggatgatgcgatcgttgatttatataaacaaaataagattacaaaagagacagcagtcatgtatgcatcaaatccgaatttgattgaaagaaaattttaattatatattattttggttacaaaacggttatattttatttaaagtcttgaaaaaagacgatttatttttttgaataagaaaatatcataattggaatatagtataattatgatgttgaaacatgtaaacaagggagtgatttttatggataaaaaattagtattaaaaatcaagaccttaggtagactgcatatcactgatggggaaaatgaatttcctcaagaaaagaaacgaagtgcccaagttgagttgttgattgtatatttaattcttaatcgaaatgctaatataactaatccacaactgattgattttctttggccagatggaaatgctgataaaccggaaggagcattaagaaatctgatttatcgagctcgaaaggaaatgaaacagttttttaaagaagttgattgtattaaatctaagggacgaagttattattggaatcctgaagttgaatgtcgagttgattatgaggagatgttgaaactttgtcgtcgtgttgaacaggaagatgatccttaccgcaagcatgaacgctgtttagaaatgatcaacaaatatcatggagaggttttaccagagtttaattataatgactggatcttagaaataaataatttgttagaacgtaattgtttagaggcaattttaaaaactttaacgattttagctaacaataacttatatgaacaggttttacaaatttgtaatcaccaaaacagtcaaaaaataatggatacacgattatatgaaatgaagctttatgcttattataagacaggtaaaacagatcttgcattatcattttatcgtcaaatcgtagattattactatagtaaatatggaattgaagtgtcacagcgactgaaagaaatttatgaaatgattctagatacttctcctgcgacacaaattgatgttgaagaattggaaaagagtctaacagttgatgataacaatgataatacattttattgtgattttgacgtttttaaaaatatttatcaaatcaatgttcgttcagcaagacgttcgatgaaagcacgaattttaactttacttacgatcgttgatacaagtggttgtttagacgaaaaggcgattcgccaagaagcagatattttaagagaagtgatttcaaatagtttgagaaaaaatgatgtttattcaaagtttaatatgacacaatattcattgattcttgcctcaccggatttagatggcgcaaaaatagcggttgatcgcattactaatcgttataatgaaaagaagaaacacgatgagattattttaacaaatgatttgaagaaaatcagataaataaaagggggagaattagagaatgggtaatttaatgaaaaaactcaagaaaaccaaaatggttaaacagtttggaattttatcgttagtattggctatgttaattggggtgatgtcaaatggaaccataattaatgcggttgatggtaatgctgatgcgaacattacatttaactcacgaatcgtagaaaaagtcaatggacaggatgttgatgtttcacaagctgattcaggagattcattctttttggcaatttattatgctgtttcagcaagtacagatgcttccaagtatactgagtgtacgttgagtatcacgttgccaaacgatattgagttcgatgaaacaacagatattagtaatactggttttgattcaattgaacaaagaacatcactagggaaaaatattctatcaattaaaagtaaagaattggcggctggacaatcaggtacgttatatttaaaaatgcattttaagaatatgacaactaagaatggcacaactgctaagtttgttgatatgaaaatgacaggttctatggttaatgaaaatggaagttatacaattaacccagtctctgtacctgatgcttcagttaccgcaaaagccagtcaagaatggactgtagggaaaaatgttattcagcaagcagatggtaataattacacgattaaatcaatagatgggaaagactattatagtgtcgattacaaagtaactgccgctccaggtagtaatcttacggatttaggtaataattatggtcggcttaactgtacgacatttgaattagtggatactttaccggttgctccagcaggacgtgaagatgggggagctgctaatatctctatcaaagtgggagataaagtactagaagaaggtgctgataaagattatgaattagttttaaatgaaaatggtactgtaaaagcaattaaaatttattatataagtacttacgaaagcaacccggatgatactaattatgtaccagatggtgctgcaatgctaactacttatacgattaatgcgaattatagcaaagatgcttatcgtgtcttaccaaatgaaaaagatgatattccgtttattttggataataaggttgagttgaaatatcttcctttgggagaaaatacgcctaagtatgtaagtgctaatgctcctgtaaatgttggctgggtagatgaaaatgcgccaacaacaaatttggatattaccaaatatgttactgttaatggtgacaacaatattgttggtgataataaatttatttttgatcaagaaaaacaagattgttattatcaaaatactgattcacgtatagcgtttggactgtatactgatgaagcgtgtcaaaatgctgcgactgatattgatggtaacacagttggtaatagcaaagttattgataaggatggtaaagtaaattttgctaaaatttctgaaggaacatattatttgaaagaaactgttggcaatttaccatttattggagatggtgttgatagtgctaatggtgaaacgatttataaaattgaagttaaaaatgaaaataataaagctgtagtttatttggatggtaaggaaattgaaaatggaaaattagaaataaataatcttacaactgctcaaggatttggttatgttgcatttaataaagtgggaacaagtgcaacgaatagccagcatggaccgcttgcgggagtaaaatttattttgaccaataaagtaactggagataaatatgaaactgtttcaaatgataaaggattagtcttatttgaaggaattattgcaggtgattatactgttgaggaagatttttcaagtgcagaatatgataaaccggatgtttataaatgggacgttaaagttgaagcaaataaagtaaactatccatctttaatgctacaagatcacaatactggggtgccatatgttgtaaatagttcgaacaaaggtaaattaattattaataaagttgatgcattgacagaaacaaaaaaattaaatggtgctgaatttactgtttatgggccttttgaatctaaagaaaccgctaatatagctattgagtctgaagatttcagtagtgtggacagttttactttaaatggtaatgaggaatcaaaagctttagttaaaggtttttatgtatatcaagaaactaaagcacccaatcattataaacttgatgaaaattattatgtgacagaattaaaaacgcaaacattaaatgaagttacagtaaaaaaatgaagaattaggatatttacaaatcttgaaaaaaggatcattaaaagattatccaactattacggttaatttagctggagctaaattccatgtttatacaaataaaaatgctacagatgatagccttgtaaaagatgatgcgggtaatccaattgtaattgaatctaacaattcggtttcaagtagttcaaattctaataaagttgagttagctgctggaacatattatttaaaagaatttgaagcgcctagtggctataatcaattaacagatgtaattacagtcgaaattcaatctggaaaaacagctactaaagagatcatgaatgaatcaactacattaggatatttagaagtgactaaaatagattctaaaacaaaggagccacttgccaatgtaacatttgatgtttaccgtaaagataatgatactaaagttgatacaattaaaacagatagtgatggtaaagctaaaactaagtttttagaagctggtgaatactacttaaaggaaacttcgaagttaactggctatgctgttaatacgaaaaatattgattttaagattgaaaataataaagaaactagtaaaactgtttctaacgatccgttagttggatatatgattagaaaagtgtcatctttagatcataatactggcttatataaagcggaatttaaattattagatgctgataaaaaggtaattgatgaaggaattgaatctaatggtcaagggtatgtaatctttactggattaacacctggagcaacatattattacgttgaaaccaaagcaccggatggatatacattaaatacgactgaatattcatttaccgcaccacaagttaatgatacaaataattcattagtttatgagagcaaagagattgttgaaaatgttcctaaaggtaagtttacaattacaaagacttcatttaatattgatgaaactatcgctaaaccagcgggaaatataacgtttgaatattttcctaagttaagtacgaatattgatgaggaccgtaaaattgctgatactaataagacgcttttaacagttacaactaataatgatggtatcgctacttcaaaaataatagatgctggagaatattgggttgttgaaaaaaatgttaaatcaaaatttgaagttgaaggtggtaatgcaaaggtcgtaactgtaaagcctggctcaaatactgatgataaattagtatcaaatgttgatgtagtcaaccgtttgatcaaaggtaaggtggcagttaaaaaggtcagctcagttgacagtgatactggagtagcagcgacatttaatgtttataaatggaatgaaacaggaaattatactggtgatccagtgtatgtacttacgacaaaagctgatggtaatgtggttactagtgaattcttagcaccggggaaatatgtattaattgaaaaagctgtggttggaaactatacaattgatccaacttcacatgaatttgagattgttgaaggtaaaacaaataaagtttatgttgaaaatccaattgaaaatgtgccatacagcagccttggtttagttaaaacagctaaatggttagataaggataataaagatgttagtgaaccgctagcaggaataaaatttagtgtctataaagcaaaagaagtatcatcagatgaagatggcgcaattagtaaagatgataaatggtatgttaaagatggtaatgctttagcaacgattgaaagtgatgttgtagagaagacggtttcaggattagagccgggattctatattgttgaagaaaacttaactgctgagcagcaaaatgattatgaacaccaaccatcaaaagtagttgaacttgaggctggtaaaacaacgcatgttacatttgaaaacacacctaaaaaaggaaaaataaaattaactaaaacaaatgaagataagacagttctattagatggagcagagtttaaaatttattacgttgatagcaatggaagccaaacaattactgctaatgatggtaaaaaatatactgtaagtgatagtgggatttcaacaaagattatttcgggaacagctgttttatatgatgcaaatggtaaatcctcaaaagatcctggggttggttattcagttttccttgatccaggtaaagaagtagtattacaagaagtaagagctccagactattatggaataatccacgaatggtggtatgttggtgaaatcaaagcacaacatattagcgaaatcgaagtacagaactatttattgactaatccaatcggttataaatacgatgaggcagaaaaattacttgctggtgctaccatgggattgtttagtactgaaactggtgcagatagattgaataagttaagtcaaactgaaatagatgaggtaattgctgattcagaaaaatgggcagaatatgatttggtaagtacagctgtatctactgataagtacttcaagtttgaaaatattgattctactcaaacttattatgttactgaattaaaacagccagctggctataataaaaacacagatattcgtaaagtgactgttgaagtcaatggtaaggtgtattttttaaaggatgctgatactaatgaaacggttatatttataaattataaatatcgtcagatctgggttagtaaagttttaaaatttgcaggtgaacaatcagcattaacaggaattaatttcaaagtatatccagttgtagaatcgaatgaaagcgttgctgatgcatttaaaataggtgataagtggtatattaaaacgggagaagaagtaacttatacaactggtactatttcttcagggaaaacaggcagctttatgacagctccttctccagctggattatatgtagttgaagaagatataacttcattaccagagcatgtcgttgcaccagatactactaaatatttagttaatttaggttttgataccgataatacggatctctattcagatcaagcagatgcttctaatgtgattgttaatactagtaattatggtaaattagcattgaataaggtgtctagtactaattcaaatacttatataaaagcgaaattcaatatttatgctaaaaatgacgaggctggacatgattatagtaaagatacaccaatttcaactatcacgacaaatggtaatcaaaatgctgtattgacagactatttgaaacctggaaattatgtgctggttgaaagtttgattagtactgatgggtatgtattgaatccaacaccacgtgaatttacaatcgaagcagataaagttactggtttagatggtagcgtttatactacggtttcagatgctgtcaagaacccattggttgtaacaaatgtaccaaagggtagtgttgaattaacaaaacaaggaacctatctagatgctaatggtctaactaatccggttgctttaagtggagtaaactttaatgtatataaatcagttaaattagctgacggtaccctagatttatcgtctactaatttagttggaacagcagtatcacaatctaatggtaagcttcagttcaaagttaatggaactgatgttactagtaaaaagtggttagaagcaggtgattacatcttacaagaaactactgtaggtactacaaataaaaataatggttttgcggattatgcatatcttggtaagtttaccattacacctggagatattacaaaagagattgtcaaagttgacgaaaatggtaatgaatcaggtaaagccgataatgttatcagtaatacttcatcttatggcaaattagaaattacgaaagttgatcattatgataaaacaaagaaattagctgatgttgtttttgaagtgtttaatgaatccggaatcttagtcgatacaattaaaacaaataaaaatggtgttgctagaacaaaattattaccggctggggaatatacactaaaagaaaaatctactaataacgattatttcttaaatgatactctttatggtccttacacagtagaggctctaaaagttactggtactgatggaaaaattgaaattactaatatgatgaaacaatcacttaaagtaattaaaaaagatagtcatactggaaaagaaattgataagttagacggtacaacatttagtttatatgatgctcaaacggatgggaatttagttgctactgcaacgtatcaaaaagataaaggaattgtttttgataatttacgcccgaacactacttattatttacaagaagatatatcaccaaatggttatgtaatcaaagattctaatcgaattaaagttacaaccaaaactaatggagaagtaacaactattgaagttgaaaatgaacctttaggaagtattaaaatcgaaaagatatcagaatggtctatttatggagcaaatgatagtaagactacacgtttcccattagctggagctgaatttactttatataaagatgtaaatggtgatagtaaactgcaagatgatgaaaaggttaatggaatagtaaaaaatagtgatactttaggaattgtcatctttgataatttagaaaaaggaaaatatttatttgttgaaacgaaggttcctgatggttatgatgaaacagttatgaatgatgtatatgctgttgaggtaactgaaggagaacaaaatattgtttataccgaagctggaaaaacagatgatgctcaaaatcatggtcctattattaatacgacaacagctggtaagtttacatttactaaaactgatcctgaaggaaaaggtttaagtggagctactttccaattgatgaaaaagaatacagatggagattatgagaattatttggattcatttacgatagaaaatacagatggtaaatttgaatcttcggtaattgaaactggtaaatatcagttagtagaaatcactgcgccagacaatttcgagattatgcagccaattgaatttacgattgaagccggcaaagtgacaacagttacttctaaagatgcaaatacagtggttaatcaagcccttggtaaagtggttattactaaatatgatgatcgcagtaactattcaaatgtgggaaataaagtcttagaaggtgttgaatttggattgtaccaagaatctggtgacttagttcaaacagtaaaaactactggtaaagatggtaaaattatatggactgatgttcctgctggaaattattatgtaaaagaagttgcgactttagacggttttgaacttgatactactgtgtatcctgttactgttgaatcaggacaaagtacagtaaaagaatacttaccaaatacagatggtaaaataatcaaccattctaatatgggtaaaatagttgttaaaaagacaagtgatgctaatgaaaacttagcaggggcagtatttaaaataactaatcctaacgatagtggttttgtaccaattattattactacaaatgaagatggaatagctaaaacagaattactgccagctaataaagaaggtacaacttatgtagttacagaaattaaagcgcctgatggttatactcttgatgacaagtatcatgacatcgaacaatctgtaaaagtatatccagtccaagatgaaacagttattttatcagaacagagtaaaaactatcttgaatttaagaataaaaagcaatctgatattatggatattgatggtaagatcataaagtatattgatggtgataataacactttattaactgcaaagactgttgaaacaccattattagatgctgcggatacagaaacattcttattgagagaatatgctcaagctaaaaatgatgtaccagtaagaagtgttgaagtggaagatagtttaattaaaatgtattattatgatgctaatggtaattcggttgaatatatgccagatgcaccttatgtagttaatactgtaacagttcatagtgcaactgataaaaatggtaataagattcaagctcgagtatactatcaaacagctggtagtgatgaatggacgactaataatagtttagttgctgatgtctcaacgaatagtcaaggaattagtttagaaggtttaaatgcattaaaaatcaaagtagtatatacaaatgttgttagcaaggacttaattgcagagaattttaatgctacaggaattgatgtgaatgtgacatttaataaacgtccttcagatgcgactgttcatgaagttagaagagtttcaaaccaaacaagtgtaacatataactatacacttaaagataatgaaggtaatgatcaaaatgcgcagtatacaaaagtttcagatatagtaaatctatattatcctttaaaagaatcagtaactcctcgagtttcactaggaattgtttctggtgagaaggataaaacttataagccaggtgaaactattgaaagtgtaattactgttaaaaatgaatcaactaaggaaaatgaaattattgaacaaccaattattagttttgatttacctatcggtatgtcactaaataataatagttatagtataggagatttacaaactaggttccaagtaatagtatttgaacatgatggagatacctcaggtaaagcattagaaccagatgaatatactgttacttatactaatgatgttcctgctcgtgttgttgaaaataatcaattagttgaaacgacatcaaaaactaagaagataacaattgatttaggtgaagattttaaatttaaacctggaatgaagatacagattagttataaaggaactagttcaattaatgatactagcacaacattatgggcaccagcatactttactagtggaaaaattattgctttgtcagctgaaaatccttatggaaatagttttactgtcgaatccgctacaggttctagttacaatacacttgttgctgacagtgtgctagatgaaattactaataaaccagatgaaaccggtgatggattaaagtatccaaatagtaacggaatcattaaaatcaatgaacaaaattatttatcaatctataaacaagttaaaggtatttatgatgatgattatttaaataataatcagattgctaaaacagctcctggcgaagatttggattataagattgtatttaaaaatggtgaaaaatcagatcgtgctgttagtaaggcgcgtgttgtagatattttaccatttgaaggtgactcgttagttaatcgtacaaatgataactatactgcaagggttacaaatcttgataaatcaccaattttaaattatgtagattgtttaacaccaggtgtttcttataaagtctactattgtgttggtgaaagtgaagatactaaatgggatgaatggaaacaagatgcccgtacaagtaaaactgcttcagaagaattgccaattgtatatggtaatatggatgatgatgattggacaagcggcgctcatcaatggatagaagcatcaaatgatattgatttaagactagttagtgctattgctgttgaatttgatttctctaatgcgccattagaacctaatcagtcaattgaattgcatgtcaacatgtctgctcctgagtacagtacttcagatttagagaaagtatctggtaagttaatgtctaactctgctttagttgcagttaaacgtactggtctagatactgtaaatgacagtgatattgttgaaaatcttgaagttaaagctgaaattgcattacctaaaggaacaatcggtgattatgcattctatgatatgaaccgtgatggtttacaagatagcaatgatttaccggttcaaggtttaaatgtaacattgcataaatttgttacaacgattaatcaaaatgaaggaaaagtaactaaagaattagattcagaaacaactttgactgatgccagtggtaaatatgaatttacaaatcaagattgtaatgttttaaaagatggtaagacggattcatcatcaactaatccaaatgattatgttggtaacaagtattatcagtatcaagttgaatttgctattccagaagatgagtctttatataaatatgagccaactcaaagatacgctcaagatgttgatggaaaaccacaaattgaagctgattctaatattggaaatgatcttaataaggatgattattgtaagacagaattatttactttgaccgcaactaaacaagctgatggcagcttagtaggagaaactaatttaacattagatgcaggatacgttgcattaggatctctaggagattttgtctggtttgatgaaaataaaaatggtattcaagatccagaagaaactggtgtaaaagatgtgattgtaaatctttatacagtaactaatggtgaggttagtggtactccagaaaaaactactagaactgatgaaaatggttactatttatttactgatttagaagatggaagttatgttgttgaatttgatattcgtggtgttaaaccaacaatgggtggtggacacgcggaacgtttctactttactaaaaatggtggaacaacagatagtgcaattgattctaatccaactattactgatgaaaataagaatactttaattgctcgtagtgaagtaattgatttagcttatcatacaagtgatatgacaattgatgctgggttaacagtttatagtgcaatatctggtgttgcatttgaagatcgtgattattctgatattcaaaattatcaagatagtgatggtaaagatgttgatatcaaattacctggtacgattgttgaattatatcgggttgatgaagaatttggaattgaaaataatatcccaacagaattagtcgcatctactgtagttggtgaagatggaagctatttatttgattatttagattctggaacatatgttgttaaattcacatatcctgaaggatataaggttattgaagcagatgttggtgatgatgatacgcttgatagtgatgtggcttatcatattgagactaatgagaataggatgtcgggatatacaggagttattaatattcctgtcaatacaagagttgataatgttgatggtggtgcaagattgtatagcagtttaggagactatgttttcaaagatgttaatgctgatggtcttcaagatgaaacagatatcgtgatgccggatgtaccagtatatttgtttgctagacaaaaaggtgaagaagtatggacatcaattgcaaatacaataactgatcaagatggtagatatcgttttgataacttaaagggttcaacttatactggtattgaatatcgtgtaatctttgatttaccacttactacaaaattgacagttccatatgctggggatgatccagaactagattctaatgctttaaatgaatatgtaccaggacttggtttcccaactcaaactattgatttagcatataatacagtagatttaacatgggatgctggaatcgttcaatcaaaaggttctgtgggtgattatgtttggtatgatacaaatgtcaatggcattcaagatgaaaatggaacaggtattgaaggtattaaagttattttagaaactaatttaacaggtaatattgctgatgaaaatgattggcaagaagtaggtacaacttatacaaatagccaaggatattatattttcaatgagctatcagaaggatattatcgagttaaatttgaaattccatcaaaatacaaagttacattgtctactcaaggagaagatagtgctgaagatagtgatggtatttatagcgaagatggagtttggtattatacccgttcattctatttagatcaagatggatatgatatgacatgggattgtggagtatatgacccgacagatacaaaattaactaaaacaggcagcactgcaactggtgatagttctgatataaatggatatgttgtcttaggatttagttcaatattggctttaggagcagtatactttgtatcaaataaaaaaagaaaagctaaaaaagctgagaaaatctagctaatttataaagaggcagattaaaacctgcctctttgtatgataaattaaagttttttgactatttgctaattttattgttttttgtgataagagtgtgatactcgaatgctattataagtgtgtaaaaaggaaatggattgaaagatttaaagggggaatgacctatgaaaaagaaattattcagattattagtggttctagcgatgattgttatgccagttacaggagtgatgatcaatgctgaagctgcttcaaatttaatgttagggacagctgtttctaacaatcctgatactagagttttcacagtaaaaaacaatggagaagcaactacatttgcatgggaggcaactggaacaggtgagactaacggtgttagtattgcaagaggtgaaactaagcgaattgaagtacctgctgtaaatggtagttcacatttgacagtattagcacaagatgctgcggccgttcaagaaattgctagtttaaatcaatactatattaatgtaacatttagtacagttgatgggacagaattaatgagtgctaaaacagtaacttgtacttataacaataatggaacctatactgcaccaagtacgatcacacttggaagcagtgtttatgatattaatggtaataactatatatctgttccttatggaacacgttcaattgattttaagtatacaaaaagagcacaaacaccatatactagtacagttgctttgattgatcaagatggtgttgagcataagatactttcttatcaagtaacagaagctaatggtggttctgttaatacaccagaaacgttcgtttcaacaatcaatggtagaacttataaaagaattgctgggcaaaaagcaacagtaagtcaaacttatgcacaaggtcaaatgagatcaattgttcgctatcaagttcaagatgatgtagctagtaagccatataatatctatattcaatatgtagataaggctactggtagtgcaattttaacgaaaaaattgttagtagaaaaagataagactgttgatcatacaccatctaaaacatttatgaagggtggaaaacaatacgaggtagttgatggagctaaaatcactcatacttttggtgatgcaacaaaaacataccaagtagaatataaacaagttattactgatgaaaatacaccacaaccaattcaagtaaattatgttgatttagcaactggagaagatttacaaattcatcaatatacagttgatcctggaaaaacaaaaacaattgaagttgacacaactgttgaaattgatggtaagacttatgttttaagtccaaatcaagaaagtacaattactcataaatttggtgaggaaactacagaatacaatgtttattttaatgaaaaaggtttagaagttgataaatatgaagtatctgtaacatatatgaatgtttcaaacacatatgtaggagaagatacattatacacaactaaattagaagccaatgttggtcaagaactaaatattgaagttcctgcacaatatgaggctaatggaacaacgtatgtattaatgagcggacaagcaactagttattcacatgatttttattcaacaagaagaaactatgtaatggtttatcgtgatgttaatgatacacaaaatgaaatagaatttattcctggtgaaactgggacggatttggctgctactactccaggaggaactaattttacaatcgatggtggaactggtaatccaatgattactaatccagatggaacagttacaacagtagatcaagatggacaaatcgttccatatgaggaaccacaaactgaagtagttgatgaaaatgaaacaccattggcaaagggtgataagtcaactagtaataatactgcttatgtaatcggtggaggttttgcaactgttgcaataatcgctggaatcgttgcttttgtaatcaaaaagaaaaaggctcaacaggcataaataatttgatcattcctatccttagtaaaagcaattcttaattggattgctttttacatttaattattactaagaaacatagtttaatttaatggacatatattagggtgattgttataatgttaagaagagtttgcgggttaaaaaataaataataaaattatgttatttatgttaattttgataattttagaaattattaattataatattattagtgggggtgatttagtgaaacttaaggttgatttttttaatgcctatgtgattaaattggatgaagatcattggctagattttaatataattaattcacccaagttggctaaattattagcttatattatttatcatcatcgtcgtaaattaagttctaatgatttacaagaattaatgtttgcttcaggtgaatcaaataatccagctaatgcgttaaaggctttgatttatcgtttgagaaccattttaaaaaataatttaggtgagtatgattatattttatcttcacaaggaacatattattggaatcctgaaatagagatgatttttgatgtagatgactttaccttgtatcatcgtttaggacgaaatgagattcatgatgaggaaataagagctaaatattatatgaaagcttattatcgatatagtggtgaatttttgccaatgatagaaaatgtggaaaagttatcgattattagaggttttttgaactcacaatttttaaatgtatcacgattcttgattgaattttatttaaaaaaggaagagtatggaattattgaagaaatttgtatgaaaaatttagctgataattatcttgatgagaacattaatgctattttagttcttgcattagttaaacaagataagataactttagctaaagaacactataataaagtcacttccgctttaaaagatgatttgggaaatgcaacgattaggaaaatgaagtattatttaaattataatgtcaataatgctgaagaaagaaatattttttctattcaagatgacttgattgaaacaaagacgagaggtgcatatagttgcgattatgatttttttaaaaagtcatatcgtttggaagcacgaaaatcaattcgtaatagaactaaaaagacgttagcagtattgactattacacctaaaaattatattaaaaataatttagaaatttataatcttgttttagaagaaacatccaatattttagaaaaagttattttaaattcattaagattaggtgatattgtttgtaaatatagtatgaaacaatttttgattttgcttgattgtgatgaaaatggagtagtaaaagcgattaatcgcattaagaaggattttttagctcaggataaatatgaacgagttagtatagattatagttatgcagcgattgcagtagcaaaaatgcatatagatgatgaagatatcttaaaacttcaataaaaaagaagtaattttcctccttagttagtaaatgataataggaggttttttattatgtttaaatacccaatatacaaacaagataataattatagttgtggagcatactgcattaaaatgattttaaaatattatcatttagatattgaaatcaaagaaatcaaagaacgttgtaaagtgactaatgagggaattagtgtttatggaataatcaaatgttttgaatcgtatcatttagatgctaaagcttatcaaagtgatttaaatacattactaaaggagacaaaatcaccttgtataattcatcttttaaatggtgaactaacacattatgtggtgttatatcgggcaacaaaaaaatacttattaattggtgatcctgcccatgggttaaccaaaagaacaaaagagtcgattgaaaaagattatacaggaatttgtatctgcattcatcatgttggaagatacagagtttctagtcgacatcaggaacaaagttttattagtttcataatacttcatttaaaaaataattactgttatattatcagacttgttgctaaagctattttgatttcttgctgtagtgttttaggatcatattatttccaagggttagtagatcaaatcaatgggatgaattatattatgattttaatttttacaggtgtttttatgataataagtgggattagaatcatgatcaattttcaaaggaaacaattggaaatagaaattcagcgatatttaaatcaagaatatgtaaataaaagtgtcgtaaatatgctgtatcttccctttagttattattatcgaaatcaagaaggagttcttcttacaaaagttcaaaatttgtttcagctaagtgatttttttattcatttttatatggctctatttgttgatttaattttaattattggtttgttaagtgccttaatactattttcaatgaatttagctttggttgtaatagcttttttaagtattattactatcgttacaattaaatggcttaaaatagttaatggtttaaataaacaaattgttgtaaaccaagaaataatgaatcaaggacatcttgagtatttgaaaaatatttataatagccatcagttttttttgaaaaaatttattaaagaaaagcttaattatttatttgaggaatataattatagcctttatcaacgggacagtgaattaaataagttgaattttattagtgaaacattaattcaattattatcttttggcgttgtattattggctagttttcattataaaaaaggaagtattagtgttggtgatattatctttttctatatgctggtatcgtatatgattgaaccaatgtttaatgttattgcttttattattaagaaagatgaaattttaattttatatgagcgttataaagagattattcctaatagaagtgaaaaaaagcaaaaaataagggggcgaatcagtaagattagttttgatcatattagctatagttacggttatagtaagccgattcttcaacatttggatcttcagattgaacgttcattatggttaaaaggtgatactggggtgggaaaatcaaccttacttaaattactgatgaagtatgatgagttattaaaggggcatatttatattaatgggatcgatttaatgaatattgatactaattctttgtatcgaaagattatttatttagatcgaaaacctgttttttatcatgaatcattgcgatttaacttgattttgaatagtaaagaggaggaactgatggaaaaattgttaaagatatttgggttaaattactatcttgaccgtcttgatttgattattgaaacagatggtcagcctttatcgtcaggtcaagcccagatagtaatgcttatcagagctatcataaaaaaaccagaagttcttattttggatgaagcattgtgcaatatagatgattataaagctaagaaaattataagctacatacatgataatttgccaaatacgattatgataatcgtagcgcatcaaacaaaattagtgaatgaattatttgactgtgctataattagagatggaaaaatatataagtaaatgaggtaattgtatggaaatcgattttgcattgataaatgaagcagctggttttaatgaagattatactgatgattatcgttcaataatcaatgaagctgcaaaacaattgggaattgaagaagatttagaattatcatgcatcttggtagatgattctaaaattcacgaaataaataaagaatatcgtaaaatagatcgggccacagatgtaattagttttgcattagaagataatgagcagttttatgtcccagggatgccaagaagtatcggagatatttttatttctgttgatcatgctaaagtccaagctgaagaatatggtcatgatttaaagcgtgaaatgtgttttttatttacccatggattattacatcttttagggtttgatcacatgatagaagaagacgaaatacagatgattgcaatgcaaaaatcaattttagatgctttaaatatcacaagacgataagtagtttattgctaatttatagacttagaaaggataaatactcaatatcatgatttaagttgagtagaagtggttttatggatgtaaaaacaataattgaaaaggcttttgaagcagcgaaaaattcttatagtccatactcaaaattcaaagtaggggcatgtattgagatgagagatggaaattactttttaggtactaatattgaaaatgcagcgtttggttcaactatgtgcgcagaacgtaatgctgtttatggtgcgtatagcaatggctatggtaaagctgatatcaaacagctggcaattgtggcaggtagtgatgagattgtttcaccatgtggagcatgtcgccaagtattgatggaactattaccacaagattgtccagtgattttggctaatcgtgaaagttatgaaataacaacaatgaaagaattattgccgcgggcatttataggagaaagtttaacatgttcaaatcaggatttgtaagtatcgttggtcgtcctaatgttggaaaatcgacactattaaatagtattttagagacaaaattagctatcatgtctgatgttgctcaaacaactagaaatacaattcaaggaattcataccgatgatgaagcccaaataatttttatggatacaccaggtattcataaaccgcaagatcgtttgggaacatttatgaatacaaccgctttaaatagcatttttggcgttgacctagttttatttttagcaccggctaatgaaaaaattggacgtggagataaatttattattgagcgcttaaaggaagccgatgggccggtgtttttagtattaagtaaaattgatactgtttcaaaagaagagctgattaaaaaattacaggagtggcaggaattatttgattttaaagaaattattccaattagtgcaactactaatgataatattgatttattacttaaaacggtaaaagcatatttgccagaagggaatatgtattatcctcaagatcatttaacagatcacccagagcgttttgtaatggctgaatttattcgtgaaaaaattctttattttactaaagaagaagtaccacatagtgttgcaattgtgatagaaagaatgctggaagatgaagcgggtgtagaaattattgcaacaattgtttgtgatcgtaaaagtcagaagggaattattgtaggtaaacaagggacgatgatcaaaaagattcgccagaatgctcaacgcgagatgaaacgttttttacaagtaccagttcatttagagttgtttgttaaggttgaaaataattggcgcaacaaacaaaaatatttaaaagaatttggatataacgaagatgattattaatggtgaagaaaatattactggactagttttaaaaaataagccttataaagaaaatgatatgctgctatggatctatactcatgattatggcaaattggcattaatagcgaaaggggtaaagaagttaaaaagtaaaaatgccccttcttgtcaaactatcactttgtcagaatttacttttattcctagaagtggtttatcaaatttgatcaaaggcgctccagttgaatattttcgctatattaaagaggatattgaattagaagcttatgcaagttatttttgtgagtttgtttataaatttactaaggataatgatcctgatgagactatatataatacgctgttattagcattacgttcattacagaccggatataatcctaaattggtctatttattatttaatgcctttattatggaaaaaacaggttcaagtttagaagttgatcaatgtgtcagttgtgggcgccttgaccatatttctggagtttcaattcatagtggtggatttgtctgtcaagaatgtattggaatgtatgatcaaaaattaacagttgatgttttaaaaggttttcgctatattaataaatggcaattagaaaatattgatatgcttcatctagaagaaaatataatcgatgaattgatgcctattatggaggcttatattgatgaatttacggggattacgtttcaaagtcgtaagtttattcgtcaattcaataatctatagaaataatcgacaaaactttatcaacttttgtcgattttatttattttttgtaaaattgtgtatataatatgtaaataaagaaagaggaatgatcatgagtgaatttttaccaataaatcgagaagaaatggaagcaaggggttggcaacaaccagattttgtatatatatgtggggatgcttatgttgatcatccttcatttggtgcagcaataatttgccgaactttagagagtcacgggtttaaagtatgttttttagcacagccggattggcataatgttgaagaatttagacaatttggcaaaccacgattaggttttttgatttcatcaggaaatattgactcaatggttaatcattatacagtagctaaaaaacgtcgtcataaagatttatatacacccggaagtgaaggctttaaaagaccagatcgcgctgtaatcgtgtatagtcaaatggcacgccaagcttataaagatgctaatattattattggtgggattgaggctagtttaagacgtttaggacattatgattattgggacaacaaagtacgtaaatcgataattattgatgctaatgcagatttattattgtatggaatgggtgaaaatagcattattgaagtagctgaagcacttgataacggcttggaaataaaatatttaacttatttagatggaactgtttttaaaacgaaaaatctcgatgatgctcacgagccagttatgttgccaagctatgaggaaatttgtaataataaaaaagcttatgcaaaatcttttcatattcagtatttaaatactgatcattttaatgcaaaaactttagtagaaccgtatcaaggatggtatgttgttcaaaataggcctaatcgtccgttgaagcaaagagagtttgatcgtgcttattcatatgattataaccgtgatagtcatcctagttataagcagcatgttcctgcaattgatgaggttaagttttctttaattagtaatcgaggatgctttggttcttgtaacttttgtgcattggcttttcatcagggaagaattgttcaagcgcgttcgcatgaatcaattattagtgaagctagcaaaatggtttgggatcctgaatttaaaggatatattcatgatgttggaggacctactgcaaactttagagggcctgcttgttctaagcaaaataaacatggtgcatgtccgactaaacagtgtttatggcctaaagcttgtaataatctagaagtaagtcatcaggattatttagaattattgaggaaactaagagtattaccaaacgtaaaaaaggtttttgttcgttcaggaattagatatgattatctaatgtatgataaagatgatactttttttaaggagttagttcaaaatcatattagtggtcagttaaaagtagctccggaacatattagtgatcaggtattagataagatgggaaaacctcggagaggactatatgagaaatttgttgataaatattatcaattaaatgaagaatacaacaaaaaacaatttttagttccgtatctaatgtcatcacatcctgggtgtacacttgatgatgcgattgaattagcagaatatttacgggatattcatcatcagccagaacaggttcaagatttttatccgactcctggaactttatctacgacaatgtattatactggtttagatcctcgtgatatgtctgaggtatacgttccaaagacggcaaaagagaaagcaatgcaaagggcattgatacaatatcgtaatccaaagaattatgatttagtgtatgaagctttagtgcaggcaaaccgaaaagatttaattgggtttggaaagaattgtttaattcgacctcgtcgcaataataatcagcgctcttatcaggctaaaaataactatcaaaagaaaaggagaaattagctatgaaatatagtgaaaaatttacatcagcaacggcaacacatgtcaattttgatatatatttaccgactgtaatgattcgctataaggctattatccagattcatcatgcaatgggagagcattcagggcgctatgaacggtttgctgaatatttagctcacgatggttttgttgtcgttgttagtgattttccgggtcatgggacttcattatataattatgagcagggttattttgggattggtgatgcaacaaagacattagttgaagatatgcatcgcttgcgaaatattatggcatctcggtatccagatttaccatattttatgattggcaatcaacttggttcattagtattacgacaatatatggcacaatatggggactttatccaaggtgctatattaatgggaacctgtggcaaacctcattttgcattgattggaaaactaattattaagggggatgcaatgcttaaaggacatatgcatcgttccaaaacggttcgtaaaaatgttatcaatcaattaatttctcgtactaaaaatgcaacttatgttactggtgatgctcgagagttagaacagtaccagcaagatccgtttactgattttacatatactaataacgcttatgaagaagtgtttggcttaataaaaaaagtttctactatccaaaacataaaaaaaatacctgaatatttatcagttttgataatttctggtgctaaggatccttttggcaaatttggcgtagggcctaaatggttatatgaagcgcttagtcatcaaggagttaaagatattactttatcgctctatgatcgtagtcatcatgatttattacacgatcaacagcgtcttgaagtgtataaagatgtacttgattggttgaatcagcgaacctttgtttgatacccttatagttggttgacaaataactactataagggtattttatatgtgcacgaaaaaatagatattaaacaaattattgcctttatttgacttgactgtgttcaagtcattcattgtttatatatctaaaataacatgaatataaggagtaaattatggcaagcaaagatatggataaattagtaagtcatgcaaaaacttcaggatttgtatatcagggttctgaaatctatgatggcttagcaaacacatgggattatggtcctttaggtgttgaaatgaaaaacaatattaaacaattgtggtggaaacgttttattcaagaatcaccatataatgtaggattagattcagctatttttatgaatccgcgggtatgggaagcgagtggacatgttggtggattctctgaccctttgattgattgtaaggaatgtaagacccgtcatcgtgcggataaattaatcgaagcttatgatccgagtgttcatagtgaaggatggtctagtgaagagacagtaaaatatatcaaggatcacaatattgtttgtcctaattgtgggaaaagcaacttcactgatgtaagacaattcaaattaatgttcgaaactcaaatgggtgtagtcgaagatgcaaaagatgtggtttatttaagaccagaaacagctcaaggtatctttgttaactttaaaaacattcaaagaacatcacgtaaaaaagtgccatttggaattggtcaaatcgggaaagcttttagaaatgaaattacaccaggaaacttcatttttagaatgcgtgaatttgaacaaatggaattagaatttttctgtaaaccagatactgatttagagtggtttgattattggaaatcatattgtcaaaagtttttatttgatttaggattaaaagaagaaaatttaagatttagagatcatgaaaaagaggaactttccttctattctaaagccacttgtgatgttgaatataatttcccatttggttggggtgaattatggggaattgctgatcgaactaattacgatttaacccaacatcaaaatcattctaaaaaatctttagaatatttagatccaacaactaatgaaaaatatattccttatgttattgaaccttcggtaggtgctgatcgtcttttcttatcagtactttgtgatagttatgaggaagaaattttagaagatggtgaaactagagttgtaatgaaattacatccaagtgtggcaccgtttaaagttgctatcttgccattaaccaaaaaacaaagtgataaagcaactgaaatttatagtcagttagcaaaatattttaattgtgaatatgatgttgctggacaaattggaaaacgttatcgacgtcaagatgcaattggaacaccttactgtgtaactgttgattttgatacaatggaagacgagacagtaactgtacgtgaccgtgacacaatggaacaaattcgtttaccaattaatcaattagttgattatattagtaaaaagatcacattctaataaggaggaacattaatgccgagactatcatcagagaaaattaatgaaattaggcaaagtgttgatattgttgatgtcattggcacgtatcttcccttagaaaaaaaaggccgtaattatgtagcgatatgtcctttccatgatgacagccatccatcgatgtcaatttcaccagaacgacaaatatttatgtgttttgtctgtcatcatgggggaaatgtttttacttttttaaaggattatttgaaaataccatatattgaagccgtcaagatggttgctaatattggtaacgttgatataagtaaatataatttagagagtcgagttaagccggtcgatcaaaaattagaaccactgtatcgtatgcatgatgaagccaataaaatttataatcattacttgaatactaagttagcaattcaagctaaagaatatttaaataatcgtaaaattacggatgaaattattgaaacctttgaaattggatacgcccctaataatcatgtactattaaaggcgtttgaaaaaatgaattttaataaggtttcaatgtttgagtctggtttgattattgaagcttcaaatggatatgatcgttttacagacaggatcatgtttccactacatgatgctagtggtcgtgtcgttgggtttagcggtcgaatctataaacaaagccaaaatgaatctaagtatatgaattcgcccgagtcatcaatttttattaagggtgatactttatataattatcaccgcgttggcgaagaagcacgacaagcgggttatatcattattactgaaggatttatggatgttattgcattatacaaggctggaataaaaaatgcagtagcaattatgggaaccgccttgacacatgggcatttaaatttattaaaacgtttaagtaaaaccgtatatttatgtttagatggtgatcaagctgggagaaatgctacaattaaaagcattgatatattattgagtgctggtttcatcgttaaggtagttgatttaccagataatttggatcctgatgaaattttggataagcgtggtatagaagaattaaacgctgtaataaaaagaccattatcttcattagattttaagatgaattattattatgaaatgacaaacatggataattatgaagatcgtaaatcttatttagaaacaattgccagagaaatcagtagattagatgatattattgatcaagatcattatatccagcaattagaaaaaaaatcaggtttttcaagaaacattattgaccagttaattaatcaaaatacagctgtaagaattgagacagcagagccacctaaaataccaaaatttcaaaatcagcgattattggataaatatataagagcggaacgtgatttattatactatatgatgaatgataaaaatgtcgcaatgatgtatgaggcaaaagcaggttttatgtttaatgatatttatcgaatcattgcttcttatattattgattattatcgtcaagaagttgtattagaggttgctgatttaatcagtagtattgaagatgaaaacttggttcaaaatataattgagatatcgcaattaggattacctaagttaaaagatactaaagccattgatgattatattgaaacaattaaagaaaaaactgtaatggtaaaaaaagaagaattaacaaaagcattggcagatacttttgatcctaaacaaaaggcgcaaatattaaaagaaatcatagcattaaaagacaaggagtaatatatgaagaaaaagaaaaatgtaactgcagtatcatttgatgatttaaagcaaattgttttaaatgatgctaaaaaagaagatggtgtattaacacaagatcaaattgataattatttatctacatatgatttaaatgatgatcttgcagaggaactattagaatttattggaaataatgatattgttatttctgatgatggattagatgatttagatgtagaagacgaagtattattagctggtgtacctgctgaattagatgatgatttaggactagatgatgatttaggattagatggtgatactccagatttagattttgctggtgatttcgatatgatgacaggtgatacgattcatatgtatcaagttgctgatgctgatgcggaattagatcaaaatcaattaggaagtaatgtcaagatcaatgatccagttaaaatgtatttaaaagagattggacgcgttgaactgcttactcatgatgaggagatagaccttgctaaaaagattttagaaggagatgaagatgcaaaaaaggaactcgctgctgctaacttacgtttagttgtatcgattgctaaaagatatgttggaagaggaatgttatttttagatttgattcaagaaggtaacatgggtttaatcaaagcagtcgagaaatttgattatactaagggatttaaattttcaacttatgcaacatggtggattcgtcaagctattacaagagctattgctgaccaagctagaacaattcgtattcctgtacatatggtagaaacaattaataaattgacaagaattcagcgtcaattgattcaagaattagggcgtgaacctagtgccgaagaaattgctgaaaaaatggatggaatgacaccagaaaaagttcgtgaaatacaaaaaatttctttagaaccagtatctttggaaacaccaataggtgaagaagatgattctcatttaggagattttatcgaagatgaaggtgcaatgtcgccagatgattatgctgctaatgaacttctaaaagatgaattgaatgaagtcttattagaattaactgatcgtgaagaaaaagtattacgcttaagatttggtttagatgatggaagaactagaacgcttgaagaagtagggaaagaatttagtgtaacccgggaaagaattcgtcaaatcgaagctaaggcacttcgtaaattaaaacatccttcacgttcaaaaagattaaaagacttcttagatcgttaaaatgaaactatcaaaaagattacagctaattgctgatgtaattagtaaatataaacaaggaagtgttttagcagatattggaagtgatcatggctatttgccatgctacttagttaaaaataagattataacttgtgcttacgcttgtgatgtagcacagggaccattagattccgcaaaagagacaatcaaacaatatggattagaagataaagtttttgcactattgggaaacgggctgaacccaattcttgatcgtgaagtggatatgatcagtattgctggaatgggatcttatttaattagtgagattcttgaagagcatcgtgagtatttaagaaatgttaaactgatgtttttacaagctaatgccaataatgatcatttacgtaaatatttatttgctaatgattggatcatcattgatgaacagatggttaaggatgctgggcatatatatgaggtgatggtagttacagcgagacagaataaagcaattacatataatcgtaaggatgaagagtttggaccaattttaatcaacaatcaaagtccattgtttaaagaaaaatggcaaaaacagtatcaagtttatgaaaagattcaaaatacattaccacatgatcatccgcgttatcatgaaattgctgataaaatgaaaatgattgaagaggtgctccatgaatgccgttaaaataattaattatttggaatcaatctttccacttaacttacaaatgtcgtgggataaatgtggaattcaagtaggtgactgtaatcaacaagtaacaagtataatggttgcattaaatgctgatatagaaagtcttcaaaaggcaattaatcaaaattgtcaaatgttagttacacaccatccatttttgctagaagaaataatgaatcttgatttccataatcatcatggaaagtttattgaaatggcaataaaaaacaatattcttgtttatagcctacatacttgtcttgatcgaggcaaagatggtatttcgatgaatgattggcttattaatgctttaggtgttcatgatgttagctgttatgatgaatttcaagtggggaaaatggcacttttaaatcagccttgtatgactagcgagttaattaagaaagttaaagatacttttaatgtaccagtacgtcttgctggtaaagaagtagagattaaaacaattgctatttgtggtggtagtggggccgatgatcttgaacagctagctggtcgagtggatgcatatataacgggtgatagtaaacatcgtcatgctaaatatgcattggatcatgatattgtcttaatcgatgttcctcatcatcttgaagtaattatggaaaagcgacttgctagtttattgagtaatcttgggattactgtaaaagaagcgaatagtcaggattattattcatattattaaaaagtattttgatgcatgtcataaagttgaatgtaagtaattatagccaagatatttacataaagtaggtatcttggtttttgacttttatgctataacataattggagctattgatgtaagcatataatgggatgtgtgtttttagttgtattaaaataactgtttaaaatattgatattgaggataattttattaggatatggtcttagggaacctagttaggcacttaagtgatgatatcgattatatgaattagaaatttgtacaatatgttcaaattttactcttattttatttaataaaaatagttttatgttctaaaaatcaatcaactataaaaaaagaaaggaacccaatgattcgattcctttacggcaatacagtcttaattaataatattatatttcaattatatgtttaaatcaaattatgctttttcatagaattgtaaataccgttattatctatattgtcagttatttcatcagcaactgctttaacccttctttagcattgccgacggcgattccaatattaacatattcaagcatttctttgtcattcattccatcaccaaatgcataagtatttttacgttcaattcctaggtagttgatcaatgtttcaatagcattagctttgtggatgtttgggactgataattcgccactgttatcaccaaaagcaggaacagtacaatggattacattgaattctcgatcaaattctttaataatattattaaatggaatattcggattttctaaaaagcaggctttattaatgtcatcacgacgcatctcttgaccttcaattagagcgttaataaaatggctgtcttttttttcatagcgagctttggcctgaggatcattttcataatcaccatatataattctttcaagtcttttaactagatttttgcttgcaaataaaccgccattactttcaacatagtaatcaaaattattagtatcaaaatagtcaaccatatgattaactgctttatttgtcacttttttatgatagagcatttgatttcctatttcaatatagccaccgccagctccaattactccgtcaattccacattcaagaatgaaatcatagatttcagccttgctgcgcccagtacataagtatactaaatttcctttagctctagttaaagcaattgctcttttggcagattcaggtacatgttcaatcccgccggtatcacttacgagtgtgccatcaacatcaaaaaatataatctttttttccatataatttctccatgtataaattataacatcgtgatatttagatataattgattttcatattttgaacaagaattgtttaagcaattcttgtaatgctggttaataaggtgtatcattttcatgttaaagcgagggagatttatggcagatcaaagtacggatttaattaaggggagtatttataaatcaattttatggttttcaattccattattgatcggtaatttatttcagcaattatacaacacagtcgattcttatgtagttggcaactatgttaacagtaatgcattagctgctgtaggagcttctaccccagtaattaatatgcttgtaggcttttttatgggactggcaacgggggctggagttgtaatttcccaatattttggggcacgacggattgaaaaaatgcagcgtgctgtccattcatcactggctcttacaggagttttatgtgttgtttttacggttgtagggctattgtgtacccaaccgcttttaaaggccattggagtaccacaagaagttttacctcattcatcgatgtatttgatgatttatttttgtggtatttcttttggccttgtttataatatgggttcaggaattttaagagcaatcggtgattcaaaacgacctttaatttatttgatcgttgccagttttgttaacatcgctttagattttttatttgtttgtagttttaattggggaatcgctggagttggaatcgcaacagtaattgctcaggcaattagtgcggtaatggtaatgtaccagttgattcacacaaaagaagattatcgagtgcaaattaatgagatttcatttgacaaacatattgttagaaaaatcgtacaagtaggctttcctgcagcatttcagcaaagtttaacatctttttcaaatgttatagtacaatcgtatattaacagttttggaactgcagcaatggctggatattcatcaacgatcagaattgatggatttttgcaattaccgttgcaaagttttaatatggcaatcacaacttttgtgggtcaaaatatgggggcaaaacaatatcaacgtgttcgtcaaggagtaaaagcagcctggttaatgtgttcaattgtaatcttagctggttcgattacaatgggattatttggtagtgagttagttggaatcttcactaatgataaagccgtaattgctgcaggggtgacaatgatcaatgtttttgcaccatgctatattattttaccgattgttcaaattcttaacggtgcattgcgtggagcagggctttctaaagtaccaatgtattttatggtaggaagttttgttattttaagacaaatctatttaatgattaccgttccattaacgcataatctagcttttgtttttgcaggatggcctgttacttgggcaatttgtgcaattggattgttaatttattatcgaagagttaattggctgccagatgaataaaagcttaattttcgagagaaaattaagctttttaaataattttagctaaatcaattttaggtttaggatgagtagaaacattttgataatcaaattgacgtaaatattcaattacttgatttgtcaagtatgttggtgtagatgcccctgagctaacagctgcagcatgtttttcctttaacatagatatatcaatatcattaacactttcaatcatataagtgtccttattagctttttcatgtgcgatactagctaattttttagtattgttcgaatgaggatcaccaacgataaaaatgacatcaacttcatcattaatttttgcaatagcttcttgacgtacagttgttgcttgacatgtttctttagcaacaattaaattatttagttttgttttagcatattcacataaatcataaacatcatataaagacattgtcgtttgatttgtaatgacatagtttaaattaggatcaagattttcaaaatcggttttattttcaatcagatggatatgagcaggatcaattgataatgctccctctgattccggatgaccagctttgccaatataaagaatttcaatcccttgatttaaataatttttaattaagtcatgagtcttaataacatcggggcaagtagcattgattacttgaatattttttgaatgagccttttttataacattatgactagctccatgagcagtaatgataaccgttccctgggaaacctgatctaataattcttcacgcgaagcaccttttttatcaatcgttttgacacctaaattatttaaagcatcaacaatatattggttatggacaatcatgcctagaatataaacatcatcttgatgggcttgttttttagctaattcgattgcacgaacaacccctttacaatatcctctgggtgtaattggatatactttcattaaatcacctcgtggttattgtaccatattttcaaactttacgtcatctgattcttcttttgtttcttttttctcttgatcgataggagtaatattttgttcaacctcatcaaagtcaatatcgttaatatgattaactgcttgaatgactctaaaagcatttttagtattgttgataatagggcggatttgatagactagaggaattacttgattaatggtataaacagttttagaggcataatgtaatgttttttgtaaattggcgcgggtttttagttttctattaacaggaaacccttgattcatgggattcatttggggattgaaattattgtagtaaaaattttcatcatagaatgggttcatttttatccctcctttattaataatgtatgcaaataattaataattgtgatattgaatacttgttattttgcttggagttagaggttatttttgcaaagggcaatagctagataaaaattgtttgggtaaactattgttgtttaactattttatttgtttttaagtgggatttaggtctttaaaactaactttgaggacttagaatagaacatactaaatctatttaaagaataggtttattttatttgctttttattttggttatgttaaaattagttgaatttatcaaagaaaggagtacaaaatgagtacatttacaaaatttaaaatgcaggaattttgtttacaaacaattgaagaattaggctttcaaaaaccaactccaattcaagaacaagtaattcctttagtgtataaaaatagtgatattattggtatttcacaaacaggtacaggaaaaactcatgcctttttgttaccggtaatggatcgcatcgatcctaagaataatagtgttcaagctgtaattacagccccgacacgggaattagcaacccaaatctataacaatgctaaattatttactaaatataatagtgagatcaaagtatctttgatcgttggaggaaatgatcgtcaaaagaccgttaataaactagcagttcaaccacatgttgttattgggacaccgggaagaattaaagatttatctttagatgaacaagctttaaaaattacaactgcttcaacttttattgttgatgaagctgatatgacgcttgaatttggatatttggaagatattgatgccgtagccgggaagatgcgtgacgatttaagaatgatggtcttttctgcaacgattccgcagatgttaagaccgtttttaaaaaaatatatgaaatcaccagtattagtagagattgatgatgataaagtaactactgaaaatgtggaacatattctaattgcaactaagcataaaaaccgttatgaggtattaaaaaagattattgagtcgattgatccttatgtatgtattatttttgctaatactcgtagtgatgttgccagtacgactaaaaaattacgagaagacggatttaaagtgggagagattcatggtgatctagaacctcgtgaacgtaagcaaatgatgcggcgaattcaaaacaatgaatatcaatttattgttgcaacggatattgcggctcgtggaattgatattgatggagtatcgcatgttattaatatggaatttcctaaagaaccggatttttatattcatcgtagtggtcgttgcggccgtggaaattatactggaatatgttacagcatgtatgatacaaccgatgaagcaaatttaaaagttcttgaacgtaaaggaattctttttaaaaatatgacgattaaaaatggtcaatttgttgatttgggtgatcgtttaaaaagaaataaacgtcctaaacaacaaaccgaattagaaaagaaagttcaaagtattattcgtaaaccaaaaaaggtaaaacctggttataaaaagaaacgtaaaagagaagttgagcaagttgttcgtaaacaaaaacgagcaatgattcaaaatgatattcgccgacaaaagaaagaaagagctcgtgcagctcaagcggctaagaggaatggagaagagaattaatgattattggtagtcatgtttcaatgtcaggaaaagagatgttattaggttcagtcaaagaggcattatcatacggggctaatactttcatgttttacactggagctccccagaatactgcccgtaagcctattgatcaattacgcattgaagaagcaaaagaattaatgaaagaaaatggaattgaaattgataatgttgttgtgcatgcaccgtatattatcaatctagctaatacaacaaaacctgagacttttgaattagcagtcagctttttaaagcaagaaatagaacgttgtaaagcgataggagcaacacgattagttttacatccaggtgcccatgtaggagctgggagtcagattggtttggaaagaatcgttgaaggattgaatgaagcaacaaaagattgtggtaatgttaaaattgctttagagacaatggctggtaaaggaagtgaatgtggtcgaactttcgatgaattgcaatatattattgaaaatgttgataataatgaatgtttaggggtctgcatggatacttgtcatcttcatgatgctggatttgatttaactaagtttgatgatattttaacagaatttgatcaaaaaattggtttggaacggttattggttgttcatgtaaatgattctaaaaatgagtgtggagcaagtaaagatcgtcatgaaaatattggatatggtcatattggatttgatacattgaatatgatcgttcatcatgataaattaaaaagtgttcctaagattttagaaacaccatatattgaaaaaattgctccatataaggaagaaattgagatgtttagaactcaaacttttaatcctagattaaagtaatggggacaatttgataaaaaacttttaattttaaggcaagtagagatacttgtcttttcacttatataattgtagagaacttcattataatggctatcgatcagtgcatagcgattattttgaattaaattataaattagtaataattgctcttcgtcaatatcaatatcctgctcatatacaagcttcttaaacatcttaaaatctaaattaaataattcattgtaactagtgttactcatcatgtttcctcctttttttcaattatatgcataaagtaaaaaagtagtactaaaatgtactacttaatcattaataaaatttctttttttaattcttcaaccatatcttcttgttttaccttgcgaatgatctcaccttttttgatcagaagaccttctttaaaaccaccagcgattccgatatcagcatgtttagcttcaccgggaccatttacagcacaacccataatagctacggtaatattagcgttgatggtatttaaaaaatcttcaatttcttgggctacgggaatcagatcatactgaattcttccacaggttggacaagaaacaagagttgggacattatcaattagctctaattctttcaaaagtatttttgctactttgatttcttctaagggactatcgcttaaagaaactcgaattgtattaccaattccttgatatagaatcgtgccaatccctaaactagatttaattgttccaccaagctttgtaccggcttctgtaacaccaatatgtaaagggtaatcaaaagtttcacttgctagtcgatatgcagcaatcgtaagtaaggtgtttgatgattttaaagaaatacagatatcatagaaacctaggctttctaatatttcaacatgctttttcgcactttcaatcattccctcagcagtaggtttgccatatttagctaaaatatctttttctaaagaaccactattgactccgattcgaattggaacgtgatgtttcttacaggcatttacaaccatttcaaccttttctggagaaccgatattaccagggttgattctaattttatcaattcctgattcaattgcctgtaatgctaaacgataatcaaaatgaatatcagcgactagcggaatactaacatgtttttttatttctttaatagctagagcgtcatcattatttaaaactgcaagtcgcactaattgacagccagttgcagctagagcatttatttgtttcacagttgcttcaatgtttttagttttagtatttgtcattgactggataattacttcgttattaccaccaatagtaaggtttcccactttgatagttcttgtttcatttctcttcatgaatttcacctcgttagaattataacatatccttccttattaataaaaataaatgttctattatatggctttattaaagaaaaggcttactagggagtagatatttgtctatttttatggtaaaattctatcgttttttatagttattattgtttggatagatagcagttataacttcaagaagataaaagaaaataggggtcattatgatggaaaatagtaaagaagaaaaggttacatctgtaagtacagaaaatatttacaagctaaatggaagagttcctttaaaaaaagcaattccttttgggttgcagcatgttttagcgatgtttgtttcgaatttagcacctgtattgattgtatgtggtgcagcacttgtaagaggaacaggagaacatttaacttcagctgagatcacgcaattgctgcaatgtgcaatgtttgtagctgggattggaacctgcatgcaactttatccagtttggaagattggttcgaaattacctattgttatgggtgttagtttcacttttttaggaagtttattagtaatttgtacgaacccagacttaggatatgaagggatgatcggagcggtcatcttaggtgggatctttgagggaattgtcggattgagtgcaaaatactggaaacgttttttaactccagttgtatcagcttgtgtagtaattgcaattggactttcacttttatcagttggaatggattcatggggcggtggaaatggtgctgctgattttgggtcatggtatcatttattagttggtacattcactttagttgtctgtttagtatcacgttatttactgaaaggtgtttataaaaatttaaatattttagtgggacttatttttggatatttactatctgttatttttacggtcgcaaatattgctccgatggtggatttttcaggaataacaaaaacaatacaagaagtaggtttttttagtattcccaagttagttttttttacgagtcatacaccagtttttgatttaggagcattcttcactattgtaatcgtatttttggtatctgctgcagaaacaacgggagcgactacagcagtgtgtaccggtgctttagaacgtgatattaagatggaggaactacaaggttcacttgctgttgatggcctttctagcgcaatttcagggtgttttggttgtattcctttaacatctttcagccaaaatgtgggattagttacgatgacaaaagttattaatcgttttaccattttagtaggggcattgattttaattttagcatccctatttccaccgttaggagcattctttaattccttaccacaagcagttttaggtggatgtacagtgatgatgtttggttcaatcatgtatgaaggaatcaaaatgcttaaagaaaatgagtttgatgagcgcacaatgatcattgtttcattagctttttgtattggggtaggattaactcaaacttcgggtaatttttttgcagcttttccaccagtagtgggagatatatttaatggtaatgctgttgcaggtgtatttgttgtatctttgttattaagtttggtgcttccgaaaaagaaagaagcaaaaaagtaaaaatgcttaaagaatcataattgattctctaagcattttttttaattgtttcaaattgatttaatagttcttcaaaatatttaaatgcatcttcataaatttgatcatctaaaggatcaacacccgcttgttttaaaagctcaacaggtgctttgctgcctccagatttcaagaaatttaaatagtcagttacttgctgctgattaccttttaaaatacgattaactatggctaaggcaacggtcatacctaacgtatatttatatacataataatcataatagaaatgtggtacataataacatgaccagccaactagttcatccatagttacatcttttccataatattcttggttaagtcgtgcatatagatcagtaataacttttgatgataatggttcattattttctgccatcgtgtgcaatttatattcaaaatcagcaaacattggctgtctaaaaatcaaaccaacacagttttctaattgttcataaataaagtatgctttttcttgatcatttttagcatttttgatcatataattaatcagtaacgtttcattaacagttgaagcaacttcagcaacaaaaatacgataattagcgttaactgcatcttgatgatgattagataaataactatgaacactatgaccaagttcatggatcatagtagaaagagaattatagtcaccaataaaattcattaagataaaaggattagtgtcataactaccactagaataagcaccaattcgtttacctggtgtaggataataatcaatccagcgttcatttcgagctttattaataatgtccaaataatcttgaccaaatggtctaagacattcattaataatttcaaaacactgatcaatcgtatactttttgttgattgaagatactagtggaatatttaaatcataattataaataacatctttctttagaagctctttttttagtcggttatagcgatgaaataagtgtcgatatttgacgtttgcactttctaaaactttaaaaaataattcactaggaacatcatcatcaaaaacgctagcttcaagagcactattgaatttacgtacatcggcataaaaagcatcctttttcattaccccggccaatgtttgagcaaagacattttcatagcgctgatactctttaaagaaattagtatatgcttgtttacgtactttttcatctttattctttaggaattggtttaaagtagcattatttaatgttttcaactttccatcttcttcaacatcttcatattcaagacgaagagcattgaatacttgactagaagtatcagcaatactttccactttagctaataattcttcttgttctttgggcagaatatgtgcttcatatgataataatgaattaatcttgtaagtatatttttctaattttggatcttttaaatattccagtactttatctttagcctcaatgatttcattatcgacaaatgatatttgtactgacgaagcttctaaaactaccattatagtggccatcatagtttgatattcctgattttttggttcgacatcacaatttaaatgagcatagcaatataatttattcattaatcgttcaaccgtatcttttgttgttaaaaaattataaaagctatcaatactattacaaattttacctttgaaagtaattaaatcattaattaaagatttagttttttctaaatcctgatagaaagcttcatggctattatagatagtacttaagtcccatgtatctttaatatcaatatcttttctctccatacaattttctcctttaaaataaaaaccctatcattagatagagtttactaatttagctaatctagatttttgtctgctagcatagtttctatgatgaattcctttaactacagaagcatctaatttagaagctacttcgttataagcttttactgcttcatctttatttccagcttcaacttcagctaatacttttttgattgcagtttttaatgctgatttatatgaagtattttttgctcttttttggttatcatttttataccgtttaatttgttgtttcatatttgccatgatctttcacctcgcttcatttcttgcttttacattatataaaaataatccaataaatgcaacttttttttgaattgatacgatattattggacaaatatgtattaaatttccataattggtgatatttataataggtgataggatgaattttagtaatatacgtagtgatttagcaaccgaatcgctagagcaactagaagttggtaagcattatcaaaaggaagagtatgttaatgatggtgttaaggttgaaaaagtttcgatccttcaggctcatcaaagtattaatcaggggattggaacttatatcgaaataagttttaaagactatttggaacaaactgctattattaaggaagttgtaaataatttaaagccattaattgataagattgattatcctaagattttgatggtagggttaggtaatcaatatttaactaatgatgcgattggcccacgaactttaagggatgtgcggattactcattttcttgatgatgaagacaaattaattaatcactattatgatattttaggtattgctcctggggtgatggtgcaaacagggatggaaactggagcgattgtaaaagcgttagtggataaagaggatattgatcttgtaatcgttgtagatgccctctgtgctaaaaattatcataaattagctcatgtaatccaaattaacgatgtagggataaatcctggtagtgggataggtaattatcgtcaggcaatcaacgaggagactgtgggtgctaaggtaattgcaattggtataccaactgttatttatgcaagcagtttagtaagtgatgtcttaaattatacgctagattactttggtgatagtttaaatccaataagtaaattaaaagtaggaaagcgtgaacgttatcatgggagcttaaatgaacagcaaaaagaaatgatgttaggacaattaggaaaattggatgatagtgaattagagctgttatttaatgaaatattgaatccgattgattgtaattttgtattaagtgataagcaaattgatgaacagtgtgaaattatgtcaaaaataataagtaaaagtattaatgcgttaaggtactaaatcctacaattcatgcatactattgtattgtatagtatagtaggtgatgcagatgagacttaaaaatacgtttttaattttattgaaattggcggttattgtaggtttaattgtttatcttccaactaaagtaagcggatcaaatgcccaagttattaatgcaattaataatgaacaaaataatccaactactccagtggcaaccaatccaaccaacactagttttgttcccacgaaagataaaaagattcatatttataatactcaccagggtgaagaatatgatggttttaatgtcgtagaaggagctaattatttaaaagattgtttaaataataaaggataccagtgcgatgttgaaggaaatgattttgaaggctataaagcggttcataaaatagcttataataaatcatatacggtatctaaaatgtatcttgaagagagtttaaagcttagtggtggttatgacttaattattgattttcatcgcgattcgatttctaaagagctgtcaaccattagccatgatggaaaatcatatgctaaaatcatgtttgttgtaggtaaaagcagtggtaaatttgatgcggttaatcagctttcacaaaaactgtcagatttagctaatgcaacagttccaaaaatcagccgtggtgtttatgtgaaaaaatctcactataatcaaggaattagtgacaatatggttctaatagaggttggcgctcaaagtaatactaaagaagaagttcaagcgacagtagaaattattgctaaagcgattggagaatatttaggatgaaaaattttttaattgatctttgtttagttggattattgttatttatgattaatggtttatttggagactacggaatccaaaaagctgtatttgacaagaatattactcagtttgaagaggatgttaaagaacaaaaaccaattactaccgattatggaactactaatgataatgaagaaaatacattatcattagtagttaaacagattagtgaagtttgtattaaagttattgaaacattagtattgattatttccaatattattagtacacttttatagtaagaaagtgatggtgtatattatgaaagatgcaaaaataatatttatgggaacagcaagtttttctaaacaggttttagaaaaattgttggaaaataattataatgttgttgctgtagtaactcagcccgatcgttttgttggtcgtaaaaaggtgttaacaatgcctgaagttaaagaagttgctttggcttctgggataccagtttatcagcctttaaaaattaaggaagaatatcaggaaatcatagccttagagccggatttaattattactgcagcttatggacaaattgttccagaagcagttttaaatgctcctaaaataggttgtatcaatgttcatgcttcattattacctaaatatcgtggtggcgcgccagtacattatgcaatcatggagggtgaagaagttacaggggtaacgatcatgtatatggtcaaaaaaatggatgctggaaatattatttctcaagtcgaagtgccaattggagcagaggaaacaacgggagaattatatgagcgtttgagtattgctggagcagagttgttactagaaaccttaccgagcgtacttgctggtacaaatgagtcaattgcccaagatgaaagtttagttacatattcaccaacaattagtcatgaacaagaaaaaatagattttagtaagagtgctcttcgagtatataatcaagtacgtggaatgaatccatggccaggtgcttataccacttatcaaggtaaagttgtaaagatctgggccggtaaaattcatgtatgtgaaaatgcccttaagcaccacgctcatcaagaaaatggaacaatcgttaagatctttaaagatgcaattggggttaaaactggtgaaggaatatatttaattacagaattacagctagctggaaagaagcgaatgttagttaaagattatttgaatggaaataatatttttgaagttgatagtaaattcgaataagcagcctaatggttgctttttttataaattaaaagatataattagagaagatacaaaggaggaaatagaaatgattatttcaactttaagcagttatcctaataaaaaagtagttaaagacttaggcatagtagtcggctatgatgatgctatacgagcttttcgagtaacaatgggagtggaagaatatattgtcaaagctcaagaaaatttagctaaagctgctgaaaaattaggtgccaatgctgtattgggggtttgctttgatttgcgtgattcaaataaaccggttttaatgggaacagctgttgttttagaagatttagagtaattctaagtcttttatttattattgtttagattaatattttgttttgtttgtagtacaatataactacggaggttgtgtaagtatgagaatggttgatttaattgaattaaagaaaaataatcatgagttaacaaaagaacaaatccattttattattaaaggatataatgatggcaatattccagattatcagatgagtgcttttttaatggcaatatgttttaatgggctgtctaaacatgaaacggctatcttaactgatgaaatgcttcatagtggggaaataattgatctaagtgaaattgcaggtgtaaaggttgataaacattcaacaggtggtgttggagataaaacatctttagttttaggaccaatggttgcagcttgtggggttaaagttgctaagatgtcggggcgtggtttaggtcatacagggggaacattagataaattagagtcgattccgggtttgcaaattcaaataagtaaagatgattttattaaacaagttaatgaaatcggtatcgcgattattggacaaagtgctacactagtaccggctgatcaaaaaatgtatgcactgcgtgatgtaactgcaactgttgattgtatccctttgattgcttcatcgatcatgtcaaaaaaattagcgtctggcagcgatactattttattagatgtaaaatatggggaaggtgcttttatgcaaactaaagaggaagctaagcgcttggcacaaacaatgattgaaattggacaacatctaggtaaagatactcgagcagctatttcaaacatgaatcaaccgctaggaaaagcaatcgggaattctttagaggtaattgaggcgattgatacattaaatggaagtggtcctgaggatcttttaaatctttgtcttgaagctggcagtcatatgttagtacaggccaaaaaatgcaaaaatgaagagtccgctttaaaaatgcttaagcgggtaattgatactggtcaagcattagataaatttaaagaaatggttaaatatcaacatggaaatgatgagtatattggtaatcctgagttgtttactaaagctaaactaattattgaggttaaagctaagcaagctgggtatattcaaactcttgaagctaaaacattaggaatagtttcaatgaaattaggcggtggtcgtcagactaaggatgatgttattgaccatagcgtagggattatcttaaataaaaaagttggagatcaatgtaaggtgggagaagtattagcttatatccatgcaaataatgaagtaagcgatgaattaattaacgaattatatggagcttataaaattgttgatttttttgttgaaaaaccgatactaattgatgaaatccttgtataatatagtcataacggaggataaagatgggtaaatatttattttttgacattgatggaactttaattggtccaagtaaacgagtaactaagaatactgaagaaggaataaagaaagcacgggcaaatggtcataaaacatttttatgtacgggacgtgctccggtgtcgataatgaaatcgatacgggatattggatttgacggaataatttcttcagccggtggttttgttagtattgatggtaaatacatctttgagaattttattaaccagtatgttttatcagaagtaatgcttttatttactaatgctaaaattttatttagcttagaaactaaagatgctttgtatcaaacaccaggtgtccaagatttttttgaaaagaagcaagcaaatattcttgaaggaaatcttgaattagcacgttttttagaagagcgtagaaatgaagaagtacgtttaccaatcagtgaatttaacattttgcaaacgaaagtaacaaaagtatgttttattgcagaagataagttggcattttatgattgtgtaaagtatttaagtgagttttttaatatcgttattttttctaaggaaacagacgattttattaatggtgaaattattttaaaaaattgtactaaaggtgatgcaatgaaacgagcagttgcatatctaggtggagatatgaaagatacgattgcttttggtgacagtatgaatgattttcaaatgattagcgaggcagcttatggagtagtatcgtatttagctcctgataagttgaaagcaattgcggatgatacatttgaagagcctgatgatgatggaatctttaagtgtctgcagcgattaggtttaatttaaattggggtaatgtaaaagaggtttatcttgacattagggaaagtgttaaaaagaattagaaaaacaaagcagattccccaaaaagaaattgttaaagtgttgaaaatcagtaagagtactgtctatcgatttgaaaaaggtggaaacattgacaccaataattatcttaagtattgtgagtatttgggtattgatgcaggaattccttattttatcagcaatcatgatgatttttatcgactgtttaatcgaattacacgaagttcatttgattatgaagtatttgagctggctttttcaaaagctttaattaagaccgctgaacaaatatttgataattacacataacagttaaaaggcctataatttaagttagagccttttttctttataagcaaaataaaacgcttgtattaattacaagcgcattattttcgttcaaattttatatacgctacaatatttgctaaaacaatcattactaaaccaacgattacaaatgtcaacatgtaagagtttaaggtacttgtaaagaaattatagaaatatgcaggtgataaactgattttatcaataaatttaccaatatagataaagaatggtaaagcgaaacacattaaaccagaagccgatagggcatatgagaaatagcgtcttctaccttgataatgactatataggcgatataataagaaacttgctaatccgattaaaacaactaaagctgctgccgcaattaaaaagattccatcatatgtatttataacatcaataacaagggctagataagggaatgataaatagcttttgtataaatcaatcaagttacttttcagtacgctaattgcttcttgtgattcactattaataataatattattagttgttaaatagttatctatatcctgggtaagttttgtttcaaattcagttgtgttaatagtggtttcaccaccatcaaaggcattattaatgtatttttccattgctgttttagcagtatcttcatcaacatagttttcaaacatttctataggaaatcctgttgactgtgtttcttgctggatttcttcatttaatgatacaactgattgtttataaaaatcagctccatccattttagaaattaagaaacttggagacataacagtaaaacgagttactgttagaactactaagatacttagaaagattgcaattaataatgataaaatatacgataatgtagttcgactacttgatttttttcttgccatgttattgtccctccaagatcgttggaccacttattttatctgcataaacaaataaacggtcagctttgtaaccaatcaattcgaatggataacatgtatataagatcaattgttctttctcgctttgggcaagatcgtaatttgattcatcagtagctttaccaattttagtatctgttattttatattcaaaatcaccataatgggtagatattttaataatatctccaacattgacatcacctaaacattcaaagtaaggcaatgagtgaccggcaattaatgaagtacggttaaatcctggtaaaaatgaaccgttgaataatccagcgcctttacgaagctgatcattaccatcaccatagtataggttaattgtcttgttgacagaatcaatggttattttaccaaataggtcaccataagaaggcattactacttctgaagctttaatagtagcagaactaactagtttatttttatatagatctttgttgctgttatcatttaaatttggtgcatgttcactagcaacaagactgtaaatagacatgactggttcaataattggactaattattaaaaataatactaggtagcagataatggtaaaagataatggcactaatactagtgccattatctttttttgcttatgttttaatcgcacgattatttaactaaaagttgttttctcttagcgtaatatcctgcaccgaataatacagctacaagtccagctgccattacagcagtttgagtgaaatcataaccagtctttttgataacgtttgtagttgaataaacaacttcgctacctttgtaaacagtgacagtaccatcagcaccaactttaatagttaacccaagtacatcagctgcagcttgagcgaaacctaaaattgcagtggcatgagcacctttgatagaagcgatatctttaatatgattagtttgcatataagattttgctccttcaatgttgttcaaaatagtagtcacttgagcagctgtaacatcattgttagttaagtaatttttagcagcattaatatcagcagcttttagattaactttaactccatcaactgtaacaccagcttctaaagcatcgatgattttttgttcatcagcagtgatagaaccaacagcaccaacagttgagatagttgcaacaaacattaagcaagctaccattaaagaacttaaaagtttcttcatcttgtcccctcctttttagttttagaatatttgcgaaagatacacaaatatacacatatataatatatcttttttggcataataacaagtaattagttaaatttagttatttaaatttgagataattttgtgacaatgataaaaaatacaaaaaaatattaaaaatttgatatataaaaaacaatttatttatgatataataataacttttatattttttttaagttaattactgttaactataaaaaaacactttaattttattaaaaattaaagtgttaaactagtttatttattttagataacctaatttagtcattttatcagtaagctgttttgctaataattcattatatttgctatttccatttatcttgtcatctaaaagactagacggagtatttttattagctagatttgttttatcttgagcagtttctgtaattcctgcatcttttaaaccgcttgttaataaataacttttaaaatctaaataatgatcaccatgtgttgtcttcaataaattatttgtagcatcacgatcatcttgagttaatgatacaacaatatatttatcagtgttaaatgcactaataatttgtttttgatattcagctaagcttccttgaacactttcttcataagaaccagtaaataatattaagatgttatccttattaatttcaggttttgttacttctattttagttaaagtattgattttactactttcaccagcttttgaacgtttgaaaactaaacgattattagctgtatcataattgatggaaccttcaatgttattgattgtacatttatcaatattggtcttacttgttaaaatagcatttacggcctggccatttttatctaataaggtaattgtagtttcttcactttttgcaggaatcgtaaagttattaacatagatttcactaacgccaaatttaattgctaaagcaagactgttaatagagtcatctccaaaagtagtaatagttgtattaatgctattttctaaatatttgggataactggtatttttgctagttccaatcgttgtactatcaccaacgcaatagatagttggtaatttgttttctaacgatgtttgattattgtttttagaagtatcgacagtttgattatcttgcttgaatttttttgctaactggttggtttggtaacgatcataggcaaataatgctactattaaaatacaaagaattggaacaacaataagaaaaatactgttttttttatttttcattgttagtaatagtagtaatatccattgctagagccatcttgctctacttgagttaatactgttccaaggatattgacattattcttttgtaagatttcgattgaagccttagcatctttacgaccagttagttgtgatgagcaaacaaagattgttccatcaaccacattaccaatcggaatagcatcactaactaacataattggaggacaatcaatgataataaaatcgtataatccttttaattcattaataaagtcttcgaagatttgactacttaataattcactagggtttggtactttgaccccagaagttaaaactgataattttcctacaaacgattcatcttcaatgaattggaaacattttgaactaatttttttagtttcaccatattcgatcaaagcgttagttaatcctcgtgagttcgatagttttaaataacgatgctgggtagcttttcttaaatcagcatcaatcaataagacatttgcatatttcgttgcatatatcatcgctaagtttaatgatgtagtactttttgattcactaggaattgaagatgtcacattgattgctttaacatttttaccaacagtagaatattcgatgtttgttctaatgtggcggtatacttctttaaaatcgattttcccatgctttttatctggcgaagtaatcagatatgtgtctttttcactctgttttttattctttttaaacatttattttctccttttaaaccaaggtaatttagatattttacgaacttttattaattcaggcgcatgtccattgataatggctagagggttatcatacatgagtctagttaaatcctcagcttgatatttttttgctaaaacttcatatgtctcttggagattaacactacgtttaccattagggcgatgaacatcattagcgattacatgaaccataccattatctaatagctggtatgcattttcttgaatcatactaccatggattcctaataaactagtgctgttaacttgaataatatagccacgatcaatccactcttgaattagatttaaatcaatactatgatgaaaataacgttctacatgagcgataacaattttttgctttattccatattcatatagacgatcatcataatcttcgggtaatttttgagtaacattaaattcaacaagtaaatacggtccattgttaatagttaaatattgatgattatctaatagttctagatagtctccattaagcataacttcacaacctggatagatttcaatttgatattctttggcaagcttttttaattcctcaatccgttctttaatttgttcaaactcttttgctgtagttgttcctggagtaagatgaggagttgctacaattttagtaatattttgaatttgagctttttttaatgctgcctgtgcatcttctcgagtttcgataccatcatcaacattccaagcataatgactatgtatatcaataaatgccatggttattcctcaaagaaagggacgattcccaatagagggacccctagatattgttcagcttgttcaccgtttttaattttagtatctaataggtatgtaagtaataaataccccaaactaataacgataccggctactgccccaataataacatttttaaccatgcttggtgaaactggattaggatttacttcaggctgatcaacgatcgtaacatttgtcacatctagcttttcttggattaaagttgtaaaaacactaattgtttcatcaacgattcttttagaaagtccaggatcaacagttgttgaagaaatttcaataatttgtgtatcagtagtatttgtaatacttaatgaactgcgtacttcggcagaagtaatatttaagtttttagcaacttgatcttgaatgttattaccttgtaataatttaacatagttatttaccatcattttatttgtattaacttgagttgagtctaatgatccattaactacatcagcttttaataatacacttccttgtgactggtattttttacttattagaaaggtagttgcagaagctgcaataattattccgactaaggctaagataataatcaagcgaatattctttttcagtaatttcaataattgtgataagtcgatttcaacttcatcatttaattcatttttatccataagtcctcccattattaatatattgaataaaactattccaaaacgtattatcctttataagcggataaaatgcaagaaattaccaataaaaattaatatttattgtagaaaaatgttaaaatagaatgtgtgacagagttgttattttataaatttaaaaaaaagaatgaaaataagattaaatttatgatggatattgtcggtaattgtaataaaatagagaaaatatggaaaatcacttgatttattgtcttaaattaatcataattgccttgtatatttgatagaatcttttatcatgcttaaaaatagaatgttaaatgattttagaaaatcgagaaatgataagtagttacttttctgagtttctagaagggagatagaacagaatgaaaagattgggagaaaagacgcaactgaatattagacgaatatttttagttagttttgatgttattagcattataattgctgcatatggatctttattattgagattcaatggacctattgagtctcagtatctacatagagtaaatatattgattggttcaatgatattaattggactagcaatctttattacttttcgtctatatcatagtttatggcagtttgcatcgataattgaactaaaaaatattatatttgcgtcgattatgagtgccatagcaaatatcttaatatgtgaattgactggaaatccattaccaagaagttgttattttatttactttttattattagtattgatggttgggggaagtcgatttatttatcgttttattaggttatatgccgcgcgtcataatataaggggaagaaaagagcaacgacctttagaaaaagtaatgattattggtgccggagttgctggggaaaaagtttataaggagattttaggttcaaagagtatctataaagaagttatttgttttattgatgatgagccaagtaaatggaatcgaacaattcatggggtttcaatatatggtggtcgtgataagatcattgaagctgtaaataaatataagatagaagaaattatggtagcgatgccttcagcaagtaaaagagatttaatcgatatctttaatatatgtaaagaaacaaaatgtaagttaaaaaagttgcctggaatatatcagtttattaatgaagatgttcatatttctgatttaaaagaggttgagattcaagatttattaggacgtgatccaataaaagttaatttagctgatattatgggctatgtaaccgataaagttgttatggtaacaggtgggggcggatcaatcggtagtgaattatgccgtcaaattgctgcaaataaaccaaaacaattaataattgtagatatttatgaaaataatgcttataatattcaattagaattaaagcataattatccagaacttaatttagagactttaattgcttctgtaagaaatgaagtcaaggtcaataaattatttgagatttatcatcctgatattgtttatcatgcggctgcacataaacacgttcctttgatggaagattcgccgaatgaggcaataaaaaataatgtttttggaacattaaatgttgctcgagctgcagataaatataatgcacaaaaatttattttgatttcgactgataaagcagtcaatccaactaatgtgatgggtgctacaaaaaggttatgtgaaatgattgttcaaacttacaataaaagatcacaaactgaatacgttgctgtaagatttggcaatgttctaggttcgaatggctcggtaattccaatatttaaaagacaaattaaagaaggtggacctgtaacagtaacccatcctgatataattcgttattttatgacaatccctgaagcagtatcgttagttcttcaagcaggtgcctatgctaagggtggtgaaatttttattttagatatgggtgagccagtaagaatagctgatatggcaaaaaatttaattaaattatctggttatgagccggatgttgatataaaaatcgagtatactggattaagaccaggagaaaagttatatgaagaattacttatggaagaggaggggcttcaagatactcctaatcatatgattcacattggaaaaccgattgagatgaatgaagatacatttgttgaaagattaataaatttaaaagaagctgcatatggagaaacagatgatattcgttcattgattaaggaacttgtgccaacttaccaatatggtattactccaaagagaagaaagacaccagaaataaagaaagattcacatgttcaagttaatgaacaagttcaagttagtaaaactgtaaatatttaaaaatgattaatcgtggtaatcgtcgctatgtcgcgttactataagtaatttgtaatatgctaatacggctagtatttgtatatagatgaatgattgaatgaatatatctatatcgatatattctagatttgatagatgtaaaatgatatgtattagcaaagctctaggcaatgatgcccagagctttttttgttagggcagttctagaaaataaaataatacttagtatgaattgctgtgatattttttggcttatgttattatcacagattagttgaatgtttaaaataccaagtatgatagtttatttgttctagtgataaatatatataattagattttcatgaatagtactagaaaatatagaaacaacacatcttgtctctgtaaaataaatcaaaattattttgtgatagtctaatttacttccctggtcatatgtttaacagctggtagaactgccaatttattaaagctgtatgatgactggtgaatagttttcaaaggagagagaaaatgttaggaagaaagagaaaaaaggccgtaaaaagtacacataaaattattgataaaagtaacaaaaataatcatgttgattatcaagaagtatatcgtaacattaggactaatattgaatattcagcagtaggaaaaaatgttaaagcaattaatatcacatcttcaattagtaatgaaggaaagagcactacggctttaaacttagcgatgatatatgcaacgaaatatgcaaatgtcttattgattgatgctgatttaagaagaccgacccaacatcattatttaaaactatcgaactcacgaggattaactaacgctttgatcgaatatggtgaaactaaaaaaattagttcaaaatattttcaatttattgaagatgaatcatttgagggaaagttatcagtactaactgctggcatcaaggtaccaaatcctagtgagttaattagtagtgatatctttgaagagtttattaatgagctgatgaagctgtatgattttatagttattgattgtcctccaattatgttagttagtgatgctattccgattggtaatgtggttgatggaacggtttttgtttgctcatcacaactaactggtcgtaaagatgctaaggcttcaatcgaaatcttacaaaagaataatgtcaatatccttggaacagtattaagtcaagtagaagttgaaaaggataaatacaataattattactattattaaggaggggcaatgagaaagtttagtgtaagaagaattattttaattttaattgatttaatttgcattattctagcaagttttttagcgctatttcttaggtttaatggagaaattccaagctattattttaatatattaaagaatttaatgggactggagatttttatctcgttggtgattttttatctttttaaactttaccgtagtttatggcaatttgcttcaattaatgagcttaaaaatattcttagcgctgcagtaattgatagtattgctaatgttttttttatttgaaatagccgataaaagtttaccgctaagttgctattttatatattttttattgattaccatgtttttagggataacaagattgatttatcgaatgactagattatatcgaacagaaaagggcagtgataattataaagagcgacgctcctaggaaaaagtaagagattaaaggcagcatagtatacagtgatagatacaatttcaattttggtggtaaattgtacaataaagaaggtactgttgttgatgggattcaagttagaacactatatacaggtttttctagtgatggtaagtatcacactaatacaaaaccaattttagaaccaggtgtatatactgaaacagtatatactttagggagtaattatgcagtaaaaccaattactcgtgtatatacaattagaaaagaaacagtacaaattaagtttgataattatttaaatgtggaaacatatgatggtacatcaaaatcattaattggaaaagtttatgataaatcgggtaacgcttttattgatgctaaattagtatataaaggtgttgataatagttataatagtactatccccccaactgcagctggtcgatatcgtgttgtagcgtcatatagtggtgatgatacacattatgcggcaataccgaaagtagcttctttagttattaaaaaggctgataaagcaattgtaactgttaatgatataaataataattatggtgaagaatacaaatattcatattctttagagggtgtagtagcacgcgatattgatacattagtatcatcgattgtttgtgttacagataacaatgaaaatgtagggaatcataaaataaaggcaattatcaatgaagatgtagctaaaaactacaaagaagtagtagttgtaaaaggaaagcatacaattacacctaaagctataaatattaatattgataacattaatacgacatatggtgatgatgaaaaagtattaacattttcactagcagtggatagtactttagcttatggtgatacattggcggatttaggaatcactttagaacgtgaatcgggaaatgatgtaggtgaatataagattactggtgatgcaagtaatgaaaactatgatgtaacatttacggatggtacatatactatagctagtaaaaaagtgcagctaataatcgatgataaaatgaaggttgaaggagaaattgatccagaatttacttataatattataggattggttaatggagatatatttactgttgagttaactagagaaccaggtgaaaaagcaggaaaatatgtaatcaatggtaaagtcgaaggggccaataattataatttagaaattgttactggtactttaacggtcaacgctaaaaccgccctacctgttaaacctgtagataagggaaccccaaccggtgataacgtagatttaaatactttgatagcattggcaggaattagtgccttactattgttaattattttaagaaaaatacatagtttaaataaatagctattatatgaaattccccactaaaaaatgatatgatccctctaaagtagacaatgtaaataaaacattgtttacgaaaggagggatcaaaatagtggggaatattattttattattgaacttatggatatatttataagtataatactaaaataattaaattataaatcatataaaaacttaatatcaactttactaaaagtgacttttaatcctctttgataaagatataatggaataaaaataaggagtgataacaatgtcattggtaaagaatatggataattggagtgatatgtctaaattagatttattatacaaattttcaataataaagtatcttcggtatttcattattccagaattgtttggcttaagcatcttggtaattgcgtcaataaaaataagaggaatatttatatttataattattgtagttataatgatgttgtatcaaattaataaaataagtcagtcttttatcaaagaaaaagcaggtaaattgatttatcgtcaaaaaacaagtttttttagatcattaagaaatttcgatgaatgtacatatagtgattattgcattagaaaaataaaaaaagttaaatcattttttaattattatgttattaacggggaaattgttaaacgtagttttattgcttatatggatgatgatgaaatttgtatagatgaaaaatattgtacagtattaaaaattcctaaagcatatcacggtttagataaattaagagatttttaagaaataggctaaggcctgtttttgtgtatataaaaaacggattttaatccgttttaaaataaatattttaatgttttaattgtttttgatagatatgttgatttagaagcattagtgtcactataaacatcataggtagcaattgttttgccatcaacaatgacatctaatgtgccaataacatcaccttgtttaaccggtaagaaattttctttatagtttactttagtagaaactttagcatcagcgctttttgctttagtatatactatatctttcttacatttgacatcaatagtcaggttatccattttatcaactagatgctgttcaattaaagtatcttttttaaaaatggtaacttgcttataattattaaaaccataatccagtaaactacacatttcttcatttcttgtttttggagctgtttctttcattaggacaccaataattctttgaccatcacgctgtgcagtggtaactaagcaataaccagcttcttttgtatatccagtttttagaccatcaacaccattatataactttaacaatttattagtattgactagccaaaagctttgtttcgtatcttcacgaatataactatcatacaatgacgttacagcaaataagtcttcaccgccgatttcaattagataggcagccattattgctaaatcatgagcacaagtgtagtgatcgggatcatgtagaccggttgcatttttaaaatgagtattctttaaacctaattttttagccttatcattcatcatctctacaaacttattaatacttccagcaatatgttcagctactgccacactagcatcattagcactagcgatagcaattgatttaaacatatcttttaaagataaactttcaccaacttccaagtaaacttgacttccgcccatactagctgcatattttgaagtagtaatttcatcatcaaacgatatttttttatttcgtagggcctcaaacattaaaatcattgtcatgatcttggttgttgaagcaggataaagcttttcttcagcatttttatcgtagagaatttgccgtgaatttgcctcaatcaagattgcagactttgcattaggagtaacatcattgtccaatgcttgaactctagagattggtagtaagcatactaccagtagggttattagtaattttttcatcaattttatcgcctccctaattaatatgtccaagtttgataaaaatacatctagtagttatgaaatttgtttatgactactttttttgtatgctttcttctagttttgtcgaaaccatttcatcattattttaaaagatgtaagatacaaacgaggagatgaaataatggaaaataagattgaatacaagatattagatgataaagttatcgtctatttttatggcgaacttagctgcagtaatgttgttaaatatcgcagcttactaaatagtattttagataagggcaatggacctgtctattttgattttttacatactaattttattgatagttcaggcattggattagttttaggacgttataatcaattgaaattagatgatcgccaattatatttagcaaatttatcaaaaacatcttataaagtttttgaattatcaggaatgtttgatttgatggaatatgtagaggaggtaaaaggataatgaaccagatggagttaagttttaacgctagaattgaaaatgagccctttgcgcgaactagcgttgcatcatttattacctcattaaatcctacaatcgatgaattagttgaaataaaaacaatcattagtgaaggggttagtaatgccattatccatggttatcaaaataatcctgaatgtaaggtaattattaaagtaacaatagaggacaatcgtcaaattaaaatcattatccaagattatggaaaaggaattgaagatattgatgaagcaaaaatacctatgtatacctcattaaaagaattagaacatgcggggatggggttaaccattatagaagccctttgcgataatttagaaatacattcaacaccggatttaggaactaaactaactattaagaaacaattgaaagactctaaccttggctaaaagtaatactattgaactgattgaacaagcacatcgcggggatgatcgtgctaaagaattagttgtcagtcaaaatcttggactagtttggtcaatagtccatcgtttcaaaaataattattatgataaagaagatctttttcaaattggatgtattggtttgatgaaagctgttaataactttgatactaactatggggtacaattctctacatatgcagtaccaatcatcatgggtgaaatcaaacgttattttagagatgatgggacaattaaagtgagtcgctctttaaaagaacttaatttaaaaataaataaagctcgtgaattactaactaatcaaaccggtcaagatccaacagttgaacaaattgcagcttatttagatgttgatgttcaagatgttgttgaggcaattgactcatcttattatccaacctcattaagtgaaccaatttatgaaaaggacggttcttctatttcaatggaggaacgaattgaaaataaacataataagatgtggtttgaaaaaattgcattagagatggaaattgataaacttgatgaaaaagagaagttaattctttatatgcgttatcagcttgattttaatcaagagcgagtcgctcagcgtttaaatatttcccaagttcaagtatcaagattagaaaagaaaattattgcaaaattacgtagtcatttaaatgaacagtaataaatgttatgatgttcataggtaataaaaatgaaagaggctacacaaagtaaaaaaagtattttattagaatatttaaaagtaattgtgctcactttagtgattacatatggagtattgtattttattcaaatatcaagagttcaaatgacttcaatggtccctacatttaaagagggaaacattgttttggtagacaaggtattgtataaaaatagtagtcctcagcgaaatgatatcgtaattgttgattataaagatgcaaatcaaaaagagaagcatattatcaaacgagttatagctattggcggagattatgttgaaattaaagataatatagtatatctaaatggcaaaaaacttgatgaaaactatgtcaatggggttatggctaataatgaggatatgtcgatcaatattcctgaaggtaaagtttttgttatgggcgataatcgtaataatagtcttgattcgcggcgtttgggttattttgatttcaaagaagatgtagttggtaaggttttctttacggttccgttctcttaataaaattattatttaaaagtaagttttagcaaaatagctaaacttacttttttttaaaattaaattatcgtaaaataacatagttacttgattgaacaacaaaaagtgttataatgacttcaggtgataaaatggaagaggctatacaaagcaaaaagagtattttattggaatacttaaaggttattgtaattactttaatagttacatatggtatattatattttgttcaaatatctagggtttatggaacgtcgatgataccaacttatcatgagggtaacattgttttagttgataaggtattttataaaaataaagaaccaaaacgtaatgatattattgttgttgattatgttgatgctgctaaaaaggaaacttatattattaaacgtgtaattggaattggtggcgatcatattgatattaaagataatcaagtttatttaaatggtaaattactagaagaagactacattaatggggttatgactaataatgaagatatgtcgatcgatatccctgaaggtaaagtttttgttatgggcgataatcgtaataatagtcttgattcacgacgattaggttattttgattttgatgaagatgtgattggcaaagttttctttacagttcctttcttttaaattaattaggtcttaacgaccttttttattttagaaagaaaattaactttttttataataagtattgtatacaatgtgccttttgtgttaaaatgacaaaaatcaataagtgggggaagtagcttgttgaagaaagaaagggtggtaaaatgagttataaatttaaaattactcgcgggaacgcgatcttaaacttttctgaagaatattgccaatctcgttgtcaattaatcgaaagtgaatcttttgcacgagttttaaaaggattcgttcacgaaggaaaaagaaaagaaaatactacttatacttatttaagagaagtaaaaagtgagagtgtggaaattgttagtgatttaagaacaatttttaaattgttattagtgatgtctgttgaagaagttttatcttcatatccacatttatcaggatattttagagatcgtgatgaatttgtaaaagtaattgaggaagtatatcttttctggagaaaattacaacgttatagtgttgtatataatgaaaatacaagtagaggatatcaaaatgttcagtttggagatgctcaagctaagtttgaagaattagttttatcagtataccgtactattgaagaaacagctttgggatatcgtcatcatgtataccgtcaaattactgcgggggttaatgcaggtttaagagtaacaaatatgcgttcattcttaccttatgaatatcgtaatttagatgatattccatttattgaaaccgtaattattcatccaccattcattacttattctaagcggaataaacgtgatggggtattcccagaaacaaaacataatccaatcgaagatttgaaatttgattctgaacaatggttctgttatccagctaaagttggagatttattagcatttgtatatttcaatgtagcatttatggctcaaggggttgctttatgtaacttatttgaattagcaagtgaagaagaatatcgtaatcgtaaaccagatatcatctatgtatacggttatgaagatggtaagatgaatcaaagtttctatcaagatgatgaaaatgatatgatggtagcattattatcagcaagtgatgattttgattactttggttatatgaaaaaaatgatgttaactttacacaatgttcgtaagatcaatcaacgtcaattacctatccatggagcgatggttaaaattacgttacattctggtgaagttaaaaatatagtagttatgggtgacagtggcgctggtaaatcagaaacaattgaacaaattaaagtatttggagcagcttatatccgtgatttagtaactgtatatgatgatatgggtgttctattattagacgaagaaggtaaagttaaaacttctggtacagaaattggagcatttgtacgacttgatgatttagatgcagggtatagttttaaagaattagaccgttctgtttttatgaatccagataaagtaaatgcgcgaatcgtaataccaatcactgattataaagatgttgttgcgcatcatgatgttgacttcttcctatatgcaaataactatgaagagggtggcgaatcattaagtttctttgatgatgtaaatagtgctttagatgtatttagagcaggaaatcgtatggctaaaggaactactactgaatacggtttagtaggcagctattttgctaatccatttggaccagtacaacgtgaagaacaaactgaagttattttagttgattatttcaatagaatgtttaaacaaggggttaaagtaggacaattaagaacacgtttaggaattaaaggaaacgaacataaaggtcctcaagaagcagctacggcaattcttaaatatattactggtgaagatgaattaaaacaattagaagaagaataaatcttagataaatggtacatcccgtgtctgcttgacgagggatgtaccacgatactaagatttttttgtttatcctcacggagcagttcttttttttataagggtgaatatggtttgatgaggggatcaaagtgaaaaagtataaactacttctaattattttagttctagttattaccttgataatattatcaattaaaccaactaatcaaatcgttttatacaactatcatcctgtcattgaaatatctaataaattcgatcctcaggctaatattcaaaaagttattggcggctcaattagtgacgttaatgtagatactagtaagattgattttagtaaagtcggtaaatatccgattacgtatatttataataacatcaaaactacgattacgattgaacttcaggatactttaaagccaaatgttgaagtacaggaagttactgttgatcttggaatgaagataactgctcgggatgtagtaaaagatatttatgataattctcggacaacagttaaattcaaaaaagattatcaatttgatcatgtaggggattacgaagttgaagtatcgatatgtcgggctaacagtaactgtgtaaccaaaaaaacagtcgtgcatgtgttacctaaagatacgactccgccagaaatattagggattcgtaatttaagtgttttaaaagatagtgatattgatcttctatcaagtgtcagtgttaaagacaatcaagatgataatccaactttaacaattgatagttctaatttggacatttctaaagtaggtgattatcaaattgtatattttgctaaagatcgttctgggaatatgacaaaagaaacatgtattgttagcgttgttgaaaataagacaataggaagttttgagcctagtgatgagaaggtagtatatttaacatttgatgatggtccatcgatgaacacccaaaaggttttagatattttagcggtttacgatgctaaagcaactttttttgtaacaggaaccaatgaaaattattatgatttaataaaaaaagctcatgaccaaggtcatacgattggattacacacttatattcatgaatatgatcaaatatataactcgtcatcagcatatttttcagatttaaaaaaaattgaagatcttgtatatagtcaaattggaagtgtgcctaaatatattcgttttcctggtggcagtagtaatcaggtttctaagaaatactgtcataagattatgagtaaattgactaaagaagtagtaaatcgcggttatcaatattacgattggaatgaggatagtgaagatggctcgggacaattatcagtaaaacaattgattaaaaatgctacagcatcgactgagaaaaatattatgttattgtttcatgatgctaatggaaaagagaattctttaaaagcaattgggcctgtaattcaatattaccaaaataaaggttacgtatttaaaggaatagatgatagttcttttgtcgtacaccatagtgtaaataattagaattcctaaaggaattcttttttgttttaaacatatactgtattggtgattagatgaaagaaaaattaattaaatatagttattatttgatgataataattatgattgtaatagctacatatgtgttaataaactggctgattccgcttttttttagttgcttgattgttttggtactgcagccgctattagctaaagaaattaaattattaaagattgaaaatatttttctttcaaaatgtttgattgtatttaattatcttctttttattggtgtaattattgccatgattatatttgctgtaattcaaatatacacggtattagagttattgcctaattatcttgaaaatttatatcagttatttagtcaaaaccattatataattgatgcaacaaagtacttagatgttatttacagtggatcaatgagcatagttgaaagtatttctactggctttattactggtttaattgcttttattatgaaaataccaagtattttatttgatttaatatttgttgttattacttcattatttattcttctagattattctagaattgaaagactggtagttaaacgatatgaaatggtggcacttataatagatacaattaaagaagtattaagtaatttatttaaagcttattttataattatgatcattacgtttggagaattatggctaggatttaaaataatagggattaatcatagtataatgctggcttgcataatagcaatttttgattttatgccggttttaggattagatatgatcatgattccatggatcataatcagtgctctgacaaataaaatatatcttgcaggagcattacttgttatctatatgattattgtaataacaaaaaatattttggaaccaaaattgattgctaaaaatcttggagtaactccagttctttcattagttgggatgtatttaggaatgaaagttatgggtgtaataggtttgattattgtgccgacattattaatggtgattatccaaattctcaaagtcaaatatcaattaaaaaataaggtagagattcaaaaatcttaaagaaggtaatgtataaattatcagctttttcatatacttgctagtaggtgagaaaatgaaaatagaaaatacagaacttaatttacatcttaaagacagtgaccagcgcttgtttgaaggatggtatttcaaaattgttgattgtaaaatttctttagcaattattgtcgggattagtaagacaattgaaaaatcttgtgcatttattcaaactttggatacatatacaaaccaaagtcagatgattgaatatagtttagatgatttccagtggggaaaagatcccttttacattagaattaaaaataatttttttactaaagaacaaattattttggatcttgataatgggctagttgatattcaaggaaacttgaaaaatagtcagtatactaaactagaaacaacatgttatgctccaacgattatgggaccttttcattatttatcatttttagaatgtaatcatgcaataataagtctgcgacatcatattactgggagcttaaaagtaaataatcagaaatttcagataattggtgatggctatattgaaaaggactggggacgttcatttccacaagattatttatggttacaatcaaatagctgtaaagaaaaagaggcaagtttatttttatcaattgctaagattccactattagcgtgtagttttcaaggattgatcatgaacttattagtagatgatcaacaaattcgagtagcaacttattatggagcaagagtaaaagatatgtttacgcgggaaggatatcattatttaattattagtcaacatcctcatacattttatttgaaaataaaagcaggacatcgttttgaattaaaatcaccacaatcaggaaagatgaatggttatgttgaagaaagtcttaatgctttagctgttttattagtttataaaaagaataaaaaagttgctaagtttaattttattaattgtggctttgaattgtttggaaattggttataagatgattaattatcatctttttttatttgtcgtggtacaatatgagtatataataatgagttatttggataagggagaaaataatggaaacaataataacagaacggttgattttaagaagtcccgataataatgatgctcaaactcttttaaagattcataatgatatggcaacgttaaagtttaatgcgatgacgaaatatgaatttgctgagatgattagagatattgagagggaacatgatatgatgtattgcatagaactaaaaaattctaataatgttattggtgctgtgtttataaatcctgatcgtttaagatatcgtgtaaatgctctcagtttatcatattatttagactgtaggtattatcgtaatggctatatgtatgaagctctgcaagctattattataaaattgtttgagcaagagattgatattattagtgctcgagtgtttaaagaaaatactgcttctgcaaggttgttagaaaaactaggatttcagtatgaaggttgtcttcgtatgggggtaaccggttatcaagagattgttcatgatgatttcttttactcaattttaaaagatgaggtaaatttgacagtataaaatttcattgctataataaaaaaagattagcgttgatacattcagcgcttttattatgaaaagaggaggaaaattatgttaaaagtatgggttgttggttccaatggccaaatcggaacagcaattaatgaagtaattgaaccattagaaatagaagttttaaatacagatcaagatgaattagatattactaatacagatgatgtgattagttttggagaaatcaatcgaccggatattatcattaattgtgctgcgattaccgatgtttataagtgtgaaaggaatcgtgatcaagcttttcgggtcaatgctttaggaccacgaaatttgtgtattgtagctcgaaaaattggagctaaagtagttcaaatttcaactgatgatgtttttgatggtaaaagtgatacaccatataacgagtttgatgtggcgaaaccgaaaacagtgtatggctgttcaaaaaaagcaggagaagactatgttaaagaatttacgcataaacattttattattcgaagtaattggatttatggacaaaatggtacaaattttgttaatgagtttatagctaaaagtaaaaaagaagattttttaaatgttgcaaatgatcaatttgggtcaccaactagtgctaaagatcttgctcgagcaattctatatttaatggaaactagtgaatacggaacatatcatattacttgtaaaggtgtgtgtagtcgttatgagtttgctaaagaaatcagtaaacaaattaatagtcatgtgatgattacgccagtttcaacaaaagagatggctgatgaggtggttcgtccatcatatgtcgtactagataattttattttacgtttagtcaatgggtatcaaatgccaacttggcaagagtcgttacaagaatatataaaagaaatcaaggaggattaggatggcattaaagaaagcgaagaaaaaaattggtttaactacaaaaatatttattgccttgatagcgggggcaattttaggaataatactatttaacttacccgctggttcagttcgggatgatattgttattgatggtattttatatgtgattggacaaggctttattaaattgatgaagatgcttgtagtgccgttagttttttgttctttggtatgtggaagcatggcaatcggagatacaaaaaaacttggttcagtaggcgttagaacgattgttttttatctttttacaacagcgttagcaatcacagtagctttattgattggtaatttgataaatcctggacttggattagatatgtcagctgttcaatcaactgctgcaaatgtagggacaacagaatctacaacacttgttgaaacacttttaaacattattccagataatccaattagtgcattatcaaatggcaatatgcttcaaattattgtttttgctttattagttggcgttattttagctaagttaggtgaacgtgctgaagtggttggtaactttttcagtcagtttaatgatattatgatggagatgactatgatgattatggcaattgcaccattaggagtattttgtttaattgcaaggacttttgcgggaataggatttggtgcttttttaccattaggtaagtatatgattgctgtcttgatagcattggcggttcagtgtttatttgtatatttaggcttactcaaattatttacgggattaaacccgattaaatttattaaaaacttttttccggttatggcttttgctttttcaactgccacttcaaatgcgaccatccctttatcaatagatacgttagctaaaaaaatgggagtttcaaagagaatttcctcatttacaattcctttaggggctacgatcaatatggatggtacggcaatcatgcagggagtggcagtcgtctttgcggcacaagcctttggaatcaatctagatctaacagattacataaccgtaattggaacagctacattagcttcaattgggacagcgggaattccaagtgttggattagttactttaacgatggtatttaattcagttgggttgccagtggaagcgattgggatgatcatgggaattgaccgtattttagatatgacacgaacagcagttaacattacaggtgatgctgtttgtacaacaattgtggcacatcaaaataaagcaatcaatcgtaatatttttgataatagtgatataaaaagagttagtgaatagtttgtaataatcatgtataataaaaggtgaagataggatcttcatcttttattttggaggatattatgaataagttatctggtttgaaaacagactgttgtggttgtagaggattttgttgtcgagcactattcttttttaaaagtgatggttttccttatgataaaccagcaaaaagaaattgtaaaaatttattagcagattatcgttgcaaaatacatgaccagctagaaattgtaaattattatggttgtataaactacgattgtcttggagcgggacaaaagacagccctgttcaaagaagatgaccagcttctatttgaagtatttgaagttatggtacagctgcatgaaattttatggtatttatatgttggtaaaaattttgtacaaagtcaacgattaaatgaacagctcgaaacatattatcagatgattgaatcattaacttatttagatgccgaagaaatccttgcacttgacttaaataagtatcggcaattagtaaatcctttattacaggaagtctattgtcaaatgaataaagatattcaaattaaaccattgcaagctagaaaaacagtactgaatcgtgctgattttatgggttgtgatttacatgaaaaagatttacgtggacaagattttaagggggcctttttaattggggcaaatttgtctaattgtgatttatgtggtgttaattttttaggaagtgatgtaagaaagatggatattagaaatagtgatttatcaaaaagtctatttctaacaccagctcaaataagtgcatgtgttattaatcggtacacaaaattgccggaatatataggctattagtaaatttgtaagagggagaagataaagatggacagagtaggaattaaattatgggctaaagaaaaaacacgatcgaataaatggaatatttggaaaggttttttagctatatttgcggcttcactaggactttcttttattgttttattactattttcagtaatgatcgacattgggggaagcagttattatgatacttttacttttatggatctagctgtgacagtgggagtatttgctttatattttttagtaattggtttttcagtcaatatatatcgttatatcaaaaaaattgtgcaggaggatattgctgatcttaatgaattgagagcacctatagggcaatattttaaacagggatttggtgttctgggtgttggacttatttgtgttttaggaacattggcatttgttgttccaggaattattttgggattagggttatcaatgacaccttatcttttagcaaattatcctagtttatcaatttttgaagcaattacaacaagctggaaaatgatgcaaggaaagaaaatgaaatgttttgtcttattttttagtttttatggctggattttattaagtacagtaacactgggaatattatttatttggttattgccatatatgacattaacatttaataaattctttttagaaaacgagaatgaattttatggtgtagttaacagtaacaataatgtaagtagtaatgatattgaagagtttgctttattaaataatttgaaacttgatacacgtaataatgtatatggaatgtttaatgattatccagtagtagtgatgtttgggagtgctaacaatgacctaattattacaatcgatactattggggaagatcgaactgctctagatgaatattttaataatttaagaacaatattaacaaacattaaaactattaattatagtaatggaacaattaccttaagtgctttgcgaagtgaggaattacatgaagtatatgagattttaaatcgaattactttaaagttaagagatctgggcttccttccaagttgtggaacttgtcatattaataaaccaacttcattctatgagtatcatggtcaattgatgaatatgtgtgatgactgtagagatgcaatcagtacccaagctgaagaaatcgttgaggacagtagccgaggaatcattggtgctgtggctggtgctctaattggtggtgtgctttgggcattggtgtatcaaatcggttttatcgtcgcattcttaggttatttaattgtttttttagcgataaatggttatcagcgaatggctggtaaaatttctaaaaaaggattaataatttcaattatttgtagcgttttggtactgttttttgcagaatcaatcagcttagggctaaaaattaaagatctgatgcaattacaaagtatttttactgcattttcatatattccttacttcctttcattcagtgaaatctttgctattgtagttagagatatagtccttggattaatctttatgggattaggaagctggcaatatatttataagattaaaaagtctttggatgaagaaaatctaaataaactcgattaaacagtttcagtagaaactgtttttttgcacaagtagtcataaataaaaaaatgcattacgtttttttcattgttgattttaaaacagtgagtttgttcaactcggcgcatcatccctagatgctcatagaaatgataattacagcttgtatcagtgtataaataaaatctattgatttgttgttcttgcatataactaatcagtagattaaataattcttttccaagacctaatccccgatactgtgcatcaattgcaaagaaagatagctcgccttgatagtcttgattagtttgttgtaacaaaactttatcaatattattgacagccttaaatattttagctgtttttcgtccctcttttcttattaagagattaaaaatattgaatccttgtttaaccctatatttaaagggacatttatgtgttttgatattttttcccataataatgccaataggctgttcctttagcaaggcaacaagcgtaaaagtttgattgcttaaacagctgcttaagaaaatttttgatagtaatttagctattttggaagtacaaaactcatcatagtgccatgcttcacgaataattttttcaattgctaaatagtcttttttaataattggtctaaaaataatttgatttttcatactattctcctttatttaatatataattatcataaagtctacggttactgtaaagtcaaggaggaacataatgttaaaaaatgaatcattaaaactaactactgcacaatttgctaaattacataaaattaataagcgaacgctacattactatgatgaaattgatttatttaaaccaaaatttaaaggtgaaaataattatcgatattacgattattttcaaagtattgaattagaaaatattctaatgctaaagcagttagatatgagtatcagcgaaattaaaagttatctaaataatcctaatgttaatgattttgtaaatattgctgatgataaaatactaaaaatagaacaagatattcgtcgtttaaaacaaacaaaaaaggtattagagataaaaaagaatcaattgttgaagagttcacgagttactgattttgaaatcgaaatcgttgagcgccaagatgaatatttattagtttcaaatgagccttttgttcaatatgatgttaaagaaattttagaatatttgcagcaggcttggaatatagaacaatataaagtagggtgtggcagttatattagtattgataaaattaaaaataatgattttgaacattacgatggtctgtttatttcccttcaaaacaaacgatatggcaaaaacgttttattacaatctaaaggaaaatatttatgtggttatgttaaaggggattgggataaaatagctgtattatatcgtagtatgttaaactttgcaaaaaaggaaaacttgaaattaataggatatgcttttgaaagaggtctcaatgaatttgcaatcaatagtattgatgagtattttactgaaatatcaattaagattagtgaataaactaatcttttttatatatagttttaaactatatataaccctatgttttaagtatttttcaataataaaaagatttgttatcctatgtacacaaggagtgtgataacatgaataaaataccgtatcgatatgatatagttggaagttttttaagaagcgagcgtttaaaacatgctcgtgagaatttcaataataatttaattagtaaaaatgaattaaaaaaaattgaaaatgaagagattttaaaattagtaaaaaaagaagaggcagctggtttaaaagctgtaagtgatggtgaattttgtcggagttattggcatcttgattttttggcaggtttaacaggtgtaaaaaaaattgaagctgaaaaatggtcagttgattttaaaggggttcagcccaaggcggcgactttaaaaattattgataaaattgattttgaagatcatgaatttttagaacatttcgaatatttaaattcaatcattgaaaatggtgtaacagcaaaaatgacgattccagcaccaacgatgctacatttaattgcctgcgttagaacaaaagaatatcagccaattgcaagatatcaggatgatgaacaattgattgtagatttagctatggcttatcaaaagattattcaggctttttatgatcgaggatgtcggtatttacagcttgatgatacttcatggggagaattttgttcaaaagaaaaacgggaggaatatgctaattgtgggattgatgtaggagcactggtcaaaaaatatgtatatttaattaacttatcgattgttaataagccagatgatatgaatataacaattcatatttgtcgtggtaacttcagatcaacttggttttcatcaggggggtatgaaccagttgctaaggaattatttggtaactgtaaggtagatgagtttttcttagagtatgatagtgatcgttcaggggattttacaccacttagatttattaaagatcaagtagttgttttaggattaattacatcaaaattttcagaattggaagataaggaaatgataaaagcaagaattaacgaagctagtcagtttgtagctttagatcaattatgcttgagtacccaatgtggctttgcatcaactgaagaaggaaataatttaactgaagatcagcagtgggctaaaattgcattagtcaaagaaattgctgaagaagtgtggggaaaataatgaaaacagcagttattggatatccaagaattggatcaaatcgagaattaaaatttgctacagagcggtatttaaagggacagattgaacaaagtgagttattacaaattgcccaaaatttaagaaaagaacattgggttgaacaagataaccaaaaaatagattatatttcttcaaacgatttttcattttatgataatgttttagatacagcctatttactaaatatcattcctaaacgatatcaagaattacaattgaattcattagatcaatattttgcaatggcacgaggctatcaaggggaaaatggagatgttaaagctttagcaatgaaaaaatggtttaatactaattatcattatttagtaccggaagttgatgatcaagttgaaattagcttaaatggaactaagatttttgatgagtttcaagaagcacttgatttagggattaagaccaaaccagtcattgttggaccatatactttaatgaaattattacgttttacagggacactaacttatcaagatattcttgatgatcttataaatgggtatttagaggttattaagaaattgagggatttaggtgcttcatggattgaggttgatgaaccagcactagtttttgatttaagtgataaagatattatcttgtttaaagaaatatatactaaaattttagataataaagagtcagtaaaaattttattacagacatattttggagatattcgtgactgttatcaaacagttttaaatttagattttgatggaattggattagattttattgaaggtaaggaaaatttaactttattagatcgttacggttttgatcaaaataaaatcttatttgcaggagtagttaatggtaaaaatatttggaagaatgaatatgaaaaaacagtttctttaattgaaaaaataaaaaataatgtcaataaaatagttttaaatacatcatgttccttgattcatgtcccttatacgattgaaaatgaaaggaatttagagcaaatatataaaaataatttttcttttgcacaagaaaaattaaaagaattatttcaattaaaggtaattatgcgaattggaaaaggacatagttattatgttgataatttagcattctttaaagagccaaataatcgtactaatgaagcagtccaagcacgaattgcagcactgaaaaaagaagactttattcgcctaccggaatttgaagtacgtcgccaaattcaaaaagaaaaatttaaattaccaattttaccaactacaacaattggttcatttcctcaaaccaaagaagtaagagctaatcgccgagcttatcgtaatggtgacattgatgaacagacatatgcggaatttaatcatcagatgattaaagaatggatcaagtatcaagaagaaatagacttagatgttttagtacatggagaatttgaaagaaatgatatggttgaatattttggtgagaatctagatggatatttatttactgagaatggctgggtacaatcatatggtactcgttgtgttaaaccgccagttatttggggtgatatttctcgagtgcgcccgctaacagtagattatgcagtatatacacaagctctaactaaaaaacctgttaaaggaatgttgaccggtccagtaacaatgttaaactggtcatttccgcggattgatatttctttggcagaaacaactttacaactggcacttgcaatcaaagacgaggttttagatcttgaagatcatggcattaaaattattcaaattgatgaagcagcactgagagaaaaattgccattacgaaaaagggattggcaaagtgaatatcttgattgggcaattccagcatatcgcttagttcatagtagtgttcaagcagatacacaaattcatagccatatgtgttacagtgaatttgatgatattattcaagcaattgaagatatggatagtgatgttatttcttttgaagcttcacgttctgatctaacattgatcgatactttaaatagagttaattttaaaactgagatcgggccaggagtctatgatattcattctccaagaattcctagtgttgaagaattagaaagagttttaacctcgatgcttgaaaaattgtctgccagcaaattatggatcaatccagattgtggcttaaagacccgagcttatccagaaactttagctagtttaaaaaatatggtcgaagcaactaaaaatattcgtgccaaacttcaataactgagtaaatagtgttagaataaggccaaaggaagtgaagaaaatgacattacaacaattacgctatgtgattacggtagctcaaaaaggctcaattagtgaagcagctaaagaattatttatttcacagcctagtttatctaatgcaattaaagaattagagaaagagatgaaaattatcattttctcacgaactaataagggtatcataataagtgatgaaggattggaatttttaggatatgcgcgtcaggttcttgaacaagcagaacttttagaaaatcgatatttagaaacaaaaagtactaaaaagcgctttaatatttcaactcagcattattcttttgctgttaatgcttttgttgatttagtaaaaaaatatagcgataacgaatatgaatttacaattagggaaactcgcacatatgaaataattgaagatgttaaaactcttaaaagtgaaattggaattctttatataaatgattttaatcaaaaagttattaataaattgttaaaagaaaacaatcttatttttaatcagctttttattgctaaaccacatatttttgttagtaatacaaatccattagctcaaaaagatattgtgactcttgaagatattgaaccatttccttatttatcctttgaacaaggacaatataattcattttatttttctgaggaaattttaagcactttagtacatcaaaaaataatcaaagtcagtgatcgagcaactttgtttaatctattgattggtttagatgggtatactatttcaacagggattattagcgaagaattgaatggtaaaaatattattgcgattccgcttgctgttgatgaaacgatcaagattggatacattgttcgaaatgatacagcgcgcagctatttaggtcaaatttttattgaagcattaaaacaaaatactcaagaattgatgcagggagtctagctcccttttttatttatgtcaatatcattcaagcaatattttaaaacttgtgatatagtagcattcaaggagggatacaggtggtggaaactagaacgatcgtatatgatgaacaattacaaattgaagcatatcagtttgttggaataatgcaaaaattccctaatcattttcatgactgttatgtagttggttttgttgaaaagggcaatcgccatttgtcttgtcgtggggatgaatatgatatggagccaggggatatgctgttattaaatcctcgtgataatcacacttgtgaaagtcgcgacggtcaaccgcttgattatcgttgtttaaatattgatgcagatgttatggtgcgagcagtaaaagaggttataggatgtagctatttaccaaattttgaaaaaccagttgcttttcaaagtgagatggtcgaatctttacgcacattgcatcaaagtgtgatgaagaaagaaacggagtttttgaaagaagaattattttatattttgatagaacagctggttaaagaatatactaataaccagccgctattaaaaagtcgatttagtgagccaatcaaattagtaaaaaagcatttagatgataattttatcaatcaaatttctttagattcattaagtgaattagcacagatgaataagtatactctaattcgtaattttgctcgttcttttgggataactccctatcaatatcttgaaacaatacgtgttaatcatgccaaagagctacttgaacagggtctcagtccacttgaggcagcaatgctttcgggatttagtgatcaaagtcattttactcgtttttttaagagcttaatcggcttgacaccgaaacagtatcaaaatatttttaaggggaaagaggatgaataaggatttttcaggacatttggctgcattattaacaatttttatttggggaacaacatttatttcaactaaaattttattaactgattttaaaccgatagaaatattattttttcgtttcttgataggtttatttattttaattttgatttatcccaaaagactaagaaaaacgacgaagaagcaagagttgacatttgctctaacgggactttgtggagttactttgtattatttattagaaaatattgcactaacatattcgatggcttcaaatatcggagtgataatctcaattgcaccgttttttacggcaatcttatcacactttattttgaaagaagagacattgaatcaaaattttataattggttttatggctgcaatggtggggattatgcttattagttttaatggcagcagtaattttaagctgaatccattgggagatatattagcattactggctgctttggtctgggctgtttattcaattttaactaaacgaattagtgattatggttatagtacgattcaggtcacaagaagaacttttatgtatggggtaacatttatgtttttgacattgatacctttaggatttaaattggatttaggacgttttagtaatccaatttatttaggaaatatcttatttttaggattaggtgcatccgctttatgttttgtaacttggaatatggcagtaaaaatattaggtgctgtaaagacgagtatctacatatacattgtaccagtagttacagtagtgacttcaatcattgttttacatgaacaaattactttaatggctttcatcgggacagtactgactttgattggattatttttatctcaaaaacgcgaggtacaaaagaatggatagaaaatgtgttatgatagttgataaaaatttgccactaggattaattgctaatacaactgctatcttaggaactgctttaggcaagttagaaggggaaatcgttgggactgatgtatatgatatgaaagaacatatacatcgtggaatagtaacgatttcaattccagttttgaagggtgatgagtttttaatcagagaactactaaaacaggctaattattatcctaatgaggtattagttattgatttttgtgaccttgctcaaagttgtcgtgattattcagaatatattgataaaatgaagctggctagtgaagcttcgcttaaatattttgggatttgtctatatggtacaaggacacgaattaataaactaacaggaaatttatcattactaaaatagaaaaaaagatgtttttagccaccaaataggctatgatatagccattggagggataaaaatggagaatattgaattagatgtacatacacatacaatagcaagcgggcatgcttattcatcacttagtgaaatggtagctggggcgaaagaaaaggatataaaattattaggaatagtagagcatgaccagggaattccaggaacatgtgctccaatttacttcaaaaatctagatgtaattcctcgagagatagagggaattaaattattgttagggattgaaattaatattttggatcatcaaggaagacttagtattacagaagatttatatgattatgttgattactgcatggcaggaattcatttacattgttatgaggcaggaacaattgaagaaaatacacgggcagtgatcgaaacaattaaaaatcctcatattagtgtaatcgttcacccagatgatggtaagtgcccacttgattatgagaaagtagttttagcagctaaaaagtatcatactttgttggaagtgaataataatgctttacgtagtccatctcgtctaaattcacgtgaaaatacacttaagatgctacaattatgcaaacaacatcgagttaaaattattttaggtagtgatgcacatattcattttgatataaaaaattatgatcaaatcgaggaactcttaaaagaagtagagtttccaaaggaattaattgttaattatcatattgaagattttttagaatatataaaaaaacaagtgagatactaattctcacttgttttcatatttgttaaatttatatctgaaattaattaaactttattaactattttttcatattagactcaaccttagtgagccattaatataattgggggtctacgtttcttatttagtacgtaatcctttttcatattaattcttaggatcattggagctacataagtatgaaccctatgatagattgaagatttaggataaataaattctttttcttcaaccatctcagttgttgttaacagacgatatgtatttaacaatgtattgattaaaataatcaatgtataaagcattaacactgaaattacatacatctcattcgtattatcaactcctttctactaatcctttcctcaccattatattagcatattttatccaaaaatgaaagggctttcaatgaaaaaatgattttttattttgattaaatcagtctttttttattttatgtaataggattttttattaataaaaaaatgtactataataaaaacattcgataaaatcatgatattttattgacagtagaaaaatatcggtatatcatatagccaagaaaaccgatgaagtggagataaaaatagatcgtgcacttatagagagcttggatggtggaatcaagtagaacgcagcctattaaatggaccactgagggcaaagtgaaaagcgttagccgagtattctttgacgttagacttacgtcagtagtcatagatgtgatagcatctactaagagcacgattgtatcgtgaaccaaggtggcaccgcggaatatatatccgtccttgacagaaaattattttctgtcgggacggttttttatttacaaaggaggaaattagcgatgtattatccaacattagaacagattaaggaaattattaaaacaggagactacaacttagttcctgtctgcaaggaaatgtatggtgatagtatcaccccaattgaagtgatgcgaattttaaaaaaacatagtaagcattgttatatgcttgaaagtgttgatgatacaaaacgctggagccgttatacctttatgggatatgatcctaaaagtgaaattacatgtttaaataatttaatgaatgtcgatggaaaggagttcatggtaactcaccctaaagattatttaaaaaagcttttgaaacaatatcaaagtcctaagatagcagggttgccaacatttactggcggactggtaggatattttgcatatgattattttaaatatagtgagccggttttaaatttgaaaagtgatgataaagaggggtttaatgatgtcgatttgatgttatttgaccaagttatttgttttgacaattataagcaaaaaattgttttgatagctaatgttgcagttgatgatttggaaaaaagttatcatgaggcattggtaaaattagaaaaaatgcaagctttaattattagtggtgttaaagctaaaattgagccattaaggctaaaaagtgatttcaaagcattatttgaacaaaatgaatattgtaacatggtagaacgtgctaaaaagtatattaaagaaggagatatatttcaagtagttttatcaaattgtttagaggctgaagtaacagggagtctttttgatacttatcgtgttttacgaacgaccaatccctctccatatatgttttatttttttagcgatgatcaagaatttgcaggggcttcaccagagactttggttaagttagaagataaaaatctttatacttatcctttagcaggaacacgaccccgaggaatgaatgaaaatgaagatgtaaattttgaagtatctttattatctgatcaaaaggaattagcagagcataatatgctggttgacttggggagaaatgatattggtagaatttctaaatttggcacggttaaagttgaaaagtatcaggagatattaagattttcacatgttatgcacattggttcaactgtctcaggggtgattcttgaaaataaagatgcgattgatgcaatcgatgcattattaccggcaggaactttatcaggtgcccctaaaataagggcttgtcaaattattaacgaactagaaaataatcgtcgcggaatttatggtggggctattggttatatagactttactggtaatcttgatacttgtattgcaattcgcttagtgtataaaaagaatgaaaaagtatatgtccgtagtggtgcggggattgtttatgatagtgttccagaaattgaatatcaagaatgtttgaataaggcacaagctgtaattagcgccctaaatacagcaaatggaggaattgactgatgattttactagttgataattatgatagttttgcttataacctttatcagttgattggttcaattgatccaaatattaaagtaattcgtaatgatgagatgactgttgatgaaattgaaaaaatagatcctaatacgatcgtaatatcgccaggacctggaaaacctagtgaggcgggaaatattgaggaaataattaaatatttttataataaaaaacctatcttaggcgtatgtttagggcatcaagcaatttgtgaagcttttggtagtacaattacttatgctaaagaattgatgcatggcaaaagttcgattatcaaaatgactgatgatttaatttttcaagggttgaaacagcaaactaaagtcgcacgttatcattcgttggcggttaaacgggaaactttagctaaggtcttgaaagccattgcactgagtgaagatggtgaagtaatggcagttaagcatattgattatccagtatatgggttacaatttcatcctgaatcaattttaactgatgatggtaaaaaaatgatagaaaactttttgggggtaaaagaaaatgattaaagaagcgattttaaaattatcgaagaaggttgatctaactgccggtgaggcacgtagctgtatgaatgaaattatgaatggtgaagccagtgatgttcaaatgagcagttatttgacagccttaagtttaaaaggagagacaattgacgagatcactggtagtgcggcaggaatgcgagaacactgtatcaaactactaaatgataaagatgttttggagattgttggtactggtggagatggttcaaactcatttaatatttctacgacatcttctcttgttattgcagcaagtggtgtaaaagtggctaaacatgggaaccgggcagctagctctaaatgtggtgctgctgatgttttagaagctttgggagtaaaaattgatgtaactcctgaaaaaagtgctacaatattaaatgacattaatatttgcttcttgtttgctcaaaattatcatattgcaatgaaatatgtggctccagtaagacgggaattaggaattaggacagtgtttaatattttagggcctttgactaatccggcaggtgctaatatgcaggtaatgggtgtatatgaagaggcattagtcgaaccattggcagaagtgttaactaatttaggagttaaacgtgccatggtagtatatggacaagatagtttagatgaaatatcattatcagccccaacaagtgtatgcgaagttaaagatggtacttatactcgttatacaataactccagaacagtttggattaacacgctgctgcaaagaagaattagtaggtggtacccctaaagataatgctaaaattacaagggatattttaagtggtgtcaaaggacctaaacgtgatgctgtgttgttgaatgcgggagctgctatttatattgccggtcgtacaaaaacaatgcaggaaggaatcgaattagctgctagattgattgatgatggtaaagcattagctaaactagaggagttcattaacaaaactaacatgtagaaggagttttaaaatgattattgatgatattgtagaaagaactttggaaagagtagcagaaaacaaaaaacgtaattccattgaaaaattagctaaattggcttttgataagccaattaataaagattatccttttgaacgagctttaagaagagctggaatttcttatattatggagattaaacgggcttcaccgtcaaaaggagtgattgctccaaattttgattataaaagtattgcaaaggaatatgaagatattggtgcagctgcaatttcagtagttacagagcccgacttttttaaaggtgatgatgactttttagctgaaattgctaaaatagtcaaaataccagtacttagaaaagattttgttgtagatgaatatatgatttatgaagctaaactattaggtgcagatgccgtattactaatttgcagtattcttgatgaaataacgctaatgcgctgtttgaatttagcagagcgtttagggatgagtgctttggttgaagcccatagttcaatgcaggtaaagaaggcattgcgtgttggtgctaagatcattggtgttaataaccgtgatttgagaaattttgaagttgatctaaataacagtattgaattacgttcgatggtaccagaaaatattatttttgtttctgaaagtgggattaagacatatgatgatataaaaacgttagaagaaaataatgttgatgctgtattagttggagaaactttaatgcgatctcatgataaacgtaagacttttgaaatcttacaaggattacgtaaaccggataatgcaaattaaaatttgtggcttatttcaagtagaagatatagattatgtaaatgaggcaaaacctgattatgttggatttgtctttgctaaaagtaaaaggcaagtagatattcatcaagcagaaaaattaaaaaataaacttgattcaaatataaaggctgttggggtatttgttgacgaacaaattagtgaaattactgctattgttaaaatggggatcattgatcttattcaacttcacggtcatgaggataatgcttatattaagcagttaaaacagtcagtgcagatgccgattattaaagccatcaaggtgattgaaaaggatgatcttaataacctggattatgaatgcgattattatttactggatagtaaaataagcggtagcggtaagtcatttgactggtcactaatcaaagatttagataaaccattttttctagcgggaggaattgatttagataatttagatgaggcaatgagtaaagctgattatggaatagatgttagtagtggggtagaaactaacggaatcaaagatcgtaataaaattatagaaatagtaaggagaacaaaaaatggaaacaggtagatatggaatacatgggggtcaatatattccagaaacattaatgaatgaaatccataatgttgaaaaagcatatgaattttataaaaatgatcctgagtttaatcgagagttagaaaaattattgaaagaatacgcagggcgcccatcgttgttatattatgctaaaaaaatgacagaagatttaggtggtgcgaaagtatatttaaaacgtgaagatttaaatcatacgggatctcataaaatcaataatgttttaggtcaagttttgatggcaaaaaagatggggaaaactcgtgttattgctgaaactggggctggtcagcatggagttgcaacagctacggctgccgctttactaggtttagagtgcgaaatttttatgggcaaagaagatactgatcgtcaggctctaaatgtgtatcgaatggagttgttgggtgcaacagttcatagtgtaacaagtggaacaatgacattaaaagatgctgttaatgaaacgatgcgtgagtggacaaaaagagttgatgatactttatatgtattaggctcagttatgggaccgcacccatttccgatgattgttcgagattttcaaagtattatttctaaggaagcacgtgaacaaatcttagaagatgaaggaaagttaccaacagctgttatggcttgtgttggtggtggaagtaatgcaatggggatgttctataattttattaatgatcaggaagttcagttgattggctgtgaggctgctggtaaaggagttgatactgctttaactgcagctacgatcaatactggatcattaggggttttccatggaatgaaatcatatttttgtcaagatgaatatggacagattgctcctgtttattcaatttcagcaggtctagattatcctggaatagggcctgaacatgctaatctacatgatattggtcgagctcagtatgtaccagttagtgatgatgaagcagtggctgcttttgaatacttagctcgtacagaggggattatttgtgcaattgagagtgctcatgctgtagcacatgctcgtaaaattgtaccatcaatggataaagaagatattgttattatttgtttatccggccgtggtgataaagatgtagctgcaattgctagatatcagggggtggatattaatgagtagaattagtgaagcctttaataataaaaaagcttttattggatttttaactgctggagatccttatcaaaaaatgacagttgaatatatcttagaaatggaaaaagcaggagcatcattgattgaaattggaattccttttagtgatccaattgctgaaggaccggtgattcaggaagctaatatacgagcattatcgaaaggaatgacaaccgatcaggtttttgaaattgtagctgaggttcgtaaacattcgaatattccgctttgtttgatgacttatttaaatccagttttccactatggatatgatgaattttttaaaaaatgtcaagaaaccggagttgatgggatcatcattcctgattgcccgtatgaagaaagtaaggaagttagtgatatttgttataaatatgatgttgatttaatctctatgattgctccaacatcaaaagagcgaacacttgaaatagcagcccaggcaaaaggttttatttatttagtttcttcaatgggagttacaggtatgcgaagcaatattgttacagatattgaaggaattgttgaatcaattaaaacggttactgatacaccagtagcggtaggattcggcattaatagtccagcacaagtgaagcattttggaaatattgctgatggtgtaattgttggcagtgcaattgttaatttaattaaagaacatggtgatcgtgcgcatcaaccattatttaattacatccagacactgattaaggaattataaaaggataattagaagggattaaattattgaaattttaattagtttagactgttaataatagttcgtttaaaaaaatgaatttgatttatagtataaaataaaactaaaaaacagcaatctatcggattgctgttaaatttagtttaaattaacttaaaaaagtattattttgataagggtttatttgaatgattgtctttaatagtcaaatgatctaataaggtgtctaacgaaccggttaataaatagcccccgcctaaaataataatcattaaaattaatagtccaactgtttccatactaccacctctatagataaaataccaaaaatagtataaaaatgacgtaagatattcactaataagattaagattgtataaagataatttctatctttatacaatcttaatactattgaggaaatctttattttatatttatgaatagtttagtatagtgaacttataagataaagtataggtaaagggagcgatgtcctatcaaagaaaaactaactgagaaattattgcatggtcttacgccaatgaagattattttctatggtttttgtattattattttaatggggacgattctcttgagtctcccaatctcgttgaaagaaaaccaggaagtttcaataatgacttctttttttactgccacttcagcaacttgtgtgacaggcttgattcgggtagatacatatagtcattggagctggtttggccagtttataattattttattgattcaaattggtggtattggttttatgactttttgtatttatgctttaacattagctaaaaagaagataggaattattagtcgttcaatcatgcagaattcaatttcttctccacatgttgggggaattgtaaaaatgacaaaatttattatcttggcgactttttttattgaagcgttaggggctttttttctttcatttattttttgtccaaaattaggattggttaaaggtttgtggttctcaatttttcatagtatttcagcgttttgtaatgcaggatttgatttaatgggtaattttgaaccatatagttcgctagtttcttttcaagataattggtatctgaatatgattattatgctcttaatcattattgggggtctaggttttttggtttggaaagatattattgataatcgtggacatttttctaaaatgcgattacatactaaaatagttattacaaccacaataattttaatattcggaggagcactatttatttatttttgtgagcaggggaatgcaactattttaagttcgttatttcaatctgtaactgctcgtacagcaggatttaatacagttgatttatcgaagattagagaaacaacacaattaatcataattatattaatgtttgtaggtggttcttcaggttcaactgctgggggaatcaaaacaacaactattgcagtaatgctagttaacattataagtatgtttaaacaaaagaaaggtgttgaagtttttaaacggcgaattagtgatgaaatagtaaaaatggcaagttgtgttttaatggcatatttagtgttgactttgattgtttcattgattatatgtcagcttgaaaatatttcttatataacggtattatttgaatgtgtttcagctatagcaactgttggattgacgattgaaataacttcacaacttggcgttatttcacagtgtctattggccttattaatgctctttggacgagttggttcaattacgttcctgcttgcttttgcttcgaatagggtgacgccattagcaaaagcaccagctgaaaaaattcaaataggatgatggaggaactatgaaatctgtattagtaatcggcttaggacgttttggacgtcatttgtcaagaaaatttattgaagaaggaaatgctgttttagcaattgaaaaagatgaaacaagagctgattgggcggttaatattgttaatgaaattcaaatcggtgatgcgactaatgaagattttattaaatctttaggagttaataattttgatatttgtgtagttgcagttggcgataattttcaaacggctttagaaatcactgtactattaaaagattttggggctgaatatataattgccagagcgagtcgtgatgttcaccgtaaattattacttcgcaatggagctgatcatgttgtttatgcagaacgggaaattgctgaaaaaatagcaattaaatatggagcaaaaaatgtttttgattatttagaattaacacctgatattgcgatttatgaaattaagattccagagagctggttgaataaaacaattatcgaaaaggcagttaggacgagataccatgttagtatcttagctactaaaaagaatgggagaatttttcctttgccaccaacaaatcatgtatttgccgctgatgaaacattgattgttatgggcactgcaaaatcaattaaagaaattacgcgttagcaaaattgtgttataatataagccgagtgaggttatattatgattaatcaacaagaacatattctactatgtctttcttcatctacttctaatcctgatgtgattaaaatggctgctgctgtagcacatgaaaataaagcaatttttactgctttatatgttgaaacaccagataattcaaaaattagtaaggatgatcgcgaaagactccaatataatactaatttggctagaaagttaggtgctaatatcgaaacagcttttggtttagatattgcttatcaaattaatgaattttgcaaaaatgctaaagtaactaaagtgttttttggacatagtcaaaaggacaggaaacatttatttagttcaaggctagataagaaattattaaatttactaaaagatttggatattaatattgtctatcatcaaaatacggggaaagataaatcaaagcaaagagattttaattttgttgttaagggtaaagatttagctatttcaatatttattctgttgatagcaaccctgatagggatattattccatcatttaggttttagtgaagcaaatacaattacagtttatattttaagtgttttaattactgctataactacatctaaccgtatttatagtcttgtatcatcgattttaagtgttttaatttttaactttatgtttactaatccacgttttactttagcagcctatggttctggttatcctgtaacctttgcaattatgctgatagccgcttttattacgagtactttagcaataaggataaaacagcaggcaaaacagtctgctcaacatgcatatcgtacaaaagttctattagagacaaatcgtcttttgcaaaaagaaaaaagtattgcaggaattaaagaaacggcagctaaacaaattgttaaattattaaataaatcagtgatgatttatcaaattactgaaaatgatacgattttacatgaagtctttcatcataataatatgactgttcatgattgtgatgagattgaaactaatgttcactgggtctaccagaataataaaacatatcaagctaagaattactatttaccgcttgctagtactaatgatatttatggtgtagtagtaataattttagaagatgttattcttgatgcttttgaaaataatttagtactatcaatcgttggtgaatgtgctttagctctagaaaaagagttttttaaccaaaagaaagaagaagctgcaattgaagctaaaaatgagcggttgcgtgcaaatttattacgttcaatttcgcatgatttacgaacaccattaactagtatttctggtaatgcaagtgtactgataaataatagcggcagcttagatgaaaataaaaaaatgcagttatacgaagtaatctacgatgattcattatggttgattaatctggttgaaaatcttctttcagttacaagaattgaagatggtaaaatgaatctgcatttagaaacagaacttattgaggaagttataaatgaggcattgaatcatattagtcataaaaaggatgaacaccgtattgaggtaaaggctaatgatgaatttattttagcaaaaatagatgctggcttaataattcaagtaattataaatattgttgacaatgcaattaaatatacaccaaaaggttcaatgattagtattgaaacctttaagcataaagattttgtagaaattcaaattgctgatgatggagcaggaatcagtgataaggacaaagaaaaactttttgaaatgttttatactgtaaagcatgaggttattgacggacgtcgcggacttggtttagggttagctttgtgtaaagctattattgtagcgcatggtggtaatattgcagttaaggacaatattcctcacggaacgatttttagttttacattgccgattaaggaggttgaaatacatgaataagccatttgtattagttgtagaagatgataacgcagttagaaatttgattgctacaactttagaaactcatgattataaatatcatacttcacaaacgggaaaacaagcaattattgaaactgcttcacaaaaaccggatataatgctgttggatctagggctgcctgatttagatggggttgaaattataaaaaaagtacgtacttggacaaatatgccaataatcgttattagtgctcgaagtgaagatcgtgataaaattgaggctcttgatgctggggctgatgattatttgaccaaacctttttcagttgaggaacttttagcaagattacgtgttattttaagacggcttaattataatcaaagtcaaaatatagaaagtagtgattttgttaatggtgatctaaaaattgattacgctggcggatgtgcatatttagatcagcaagaactgcatttaacaccgattgaatataagttgctgtgccttctctcaagaaatgttggcaaagtattaacacatacatatattactaaagaaatttgggggagtactttagagagtgatgttgcctcattaagagtatttatggctacgcttcgtaaaaaaatagaattagatcctacgcatcctaaatatattcagacccatgttggagttggataccgaatgttacgaattgaataatatgagtgaaacagtttgtttcacttttcttttttgttaattgcggtaaaatataaatataataagtatagggggaaacttagggtgtggattggattagcttgtctatcagctttatttgctggggttactgcagttcttgcaaaaattggtttgaagaatgttgattcttctttagcaacagcattaaggacaataattgttttaattttttcatggataatggtcttatttgctggaacccaggaacaattaaaatatattgatagtaatacagtattggttttatgtttttctggaattgcaactggattatcatggttatgttattttaaggcactacaattaggagatgttaacaaagttacaccaattgataaaagtagtacaattttaacgatgctgttagcatttattttctttgacgaaaaaattactatgcttaaaataatttctatgataattatgtctttaggaacttatatgatgattgaaaaaaagcaggttgtaaataaagtgacaaataaccattggctattatttgccttggcttcagctttatttgcttctttgacggctataattgctaagattgcaatgcttaatattgatagtaatctgggaacttttattcgtacagcggtagtattgattatggcttgggggattgttttttatcagcgaagttatcatacaattaaagaaattacaaaaaagaattggctttttttattttcttctggaattacaacaggtttatcatggatctgttattataaagcgttgcaattaggggaggctagtattgtggttccaatcgataaactgagtatcatcgtcacaattatcttttcgtattttgttttaaaagagtctttgtcaaaaaaggctgtggcgggattgattttgatcgttgcaggaacaatgttattattgatttaaagggaggaaattatgagagaatatcatttaattgaacctgtatataataaaagttctaaaatattaattttaggttcttttccatcagtaaaatcgcgggaggccaactttttttatcatcatccgcagaatcgtttttggaaaattcttgcaaatatttataatactgaattaccagagactattattgaaaagaaagaatttttaataaatcaacatatagctgtgtgggatgtaattgctagttgtgaaatcaaaggttcgagtgatagtagtattacaaatgttgaagtcaatgatctaaagaaaatcattgatcaaagtcaaattacgcatatttatacaaatgggaacttagcagatagattgtatcatcgctatttcgatgaaattattgatcttcctgttactaagttaccatcaagttcaccagctaatgcgagttattctttgacgaaattaattagtttttggaaagaaataaaatcgttataatatattaatagaaagcaaaaaactcaaaaagagttttttaattatgtttcattttatatttaaatagtgaaacagctgcaattaagaggagtccagcgtagcttaaaacccagaataaattattaggcattgcgtgataattcgcatttaagccatctcgtgccatatctacagcatggacaaaaggaaaacaatacgcaatatctttaaacaagcctccaattaaatctaaactaaaccatgtcccacttagccacgcggtaagattagttaataaggcaccacagattcctccgacttgtctatcattaaaaatagtgccacaaaataagccgattgcaataaaaataattgaaatggggattgtacataagatggcaataatgacatcaggtgttatttttaaacctagacaaaatgctgctagatagcaaagtaaagtctgtatcaaggccattggtattaatggtaaagtatatcccaaaatataatctttagctgtcataggagtagtaaataatcgtgctaataatgatgacattcgatcacgagagatcaatgtagctgaaaataatgataagaaggacaagccaaatactgcaattcctggtgttaattgttttagtgaaaaaggggtggctggaatatttttttggattgttgtcaatagtaacaagataacgattggaaaacctaaaccaaaaataatattaatagggtcacgtaaaatttcttttgtggttcttttagcaaaggcccatgttctcattttcagtccctcctgttgcaagttttataaaggcatcttcaaagctggttgtcttggcaaatttaattagttcatttgtggttcccagggctttgattttaccatctttcataatacaaacataatctgataaagcttcggcttcttcgagataatgggtagttaaaatgatagtaatcttaccttttagtgcttttattgtgcgccataattgttctctggctaaaatatcaagtcctagtgttggctcatctaaaaataaaatttgtggctcactaattagggccatagcaatacttaagcgccgttgataaccacccgatagttttttactttttttagcagcaacatctttcaaattaaaagcggtaatcatttcgatgactttgttattgattaaagtttttttaaaaccatggatttccgccattaattccaaattttctctaacggttaaattcggtgcgattgcagtttcttggggtgaaacggcgataagctctttaacaaagaggctttcattaacaatgctatagttattgattctagcatcaccgcttgttggttgaatcaaacccgataacattttgagtgtagtagttttaccggctccatttactcccaatagagctagtaattttccttgtttgattgatagatttaaattatcaacagcaagtttatcattatatttttttgttaaatttttaatttcaatcatttccatgataatcagtccttttcatttttgggtactcctaattcactaacaaagttaataacatcacgctgatggacaatagctagaccacgttcttcatcaccaaggatcaaaattttatcaccagcggaaattttaaagattcgacgtgcttcttgaggaattacgatttgtccacgttcaccaacagtaactgctccaaaaaaatgttttcctttgggaggaattacgattccagcatcatcttcatcatgattgattaaattatcaattgttacattgtatatttttgccaatgccatacagctgtcaatatcaggcaatgattcaccgctttcccattttgctacagattgacgtgatacaccaacttgctgtgcaatttcttcttgagtatattgataatgttttctaagccaaacgagattcgtactaagcatatttttcatacctcctatatttaggattatacgttaaaatcaattattgtctatcaatcaaagttgccttgaatgttaaaaatagttgcataataaaacggtatgactgtccataccgttttacatttattcacttaaatcttcaccatttgtggcaatgactttcttataccagtcaaaagattttttcttacatcttgaaaaatctccttcatgattattattgtaattcacatagataaatccatagcgtttatcatattcaccagtagaagcagagacaatgtcgatcggtgaccacattgtataacctaataattctactccatcatagtcaactgcatccctcatagcttcgatatgtgctgctaaatagtcgatacgatactgatcatcgattgttccgtctgcttctactttgtcataagcaccaaaaccattttcaacaatcatcattggtaactcaaaacggtcatggaaccagtttaggcaccagcgtaatcctagtggatcgatttgccaaccccagtctgaagcttttagatgagtatttcgaacaaagtcctcactgaaataatcatatgttttttcattacgtccttgatattttgaagcaaaactcatgtaatatgagaatccaatatagtccactttaccttgagataaaatctttttatcttcttcagtaataaagtcataaccttttctttcgaattttttcaatatatgatttgggtagtgaccacgggcatggacttcaacataccagtatttttgatgcattgctcctaaagcgttcattacatcagttggattaggtgatgcagggtaaacagcattcatcccaatcatacatccaacttgtaaatcaggattgatctcatgagcggctttaacagctaaagcagaagcgactaattcatggtgagcagataaatacattaaatattctgcatcatcatctttttttaaaagtacagctccttcttggattaagttgtgctgagaaacatcagcttgattattgatttcattaaaagtcatccagtatttaactttatgctggtatctttcaaagcatactttggcaaatttaacgaacatttcgattgcttcacgatttctaaaaccaccatactcttttgcaagcgtccaaggcatttcgaagtgcgataatgttataattggctcaattccatatttatgacattcatcaaataaatcatcataaaattgtaaaccctcttcgttaggtgtttcttcatcaccccgaggaaaaattcgtgtccaggcaatagaagttctaaatgctttgaatcccatttcagcgaataaagcaatatcttccttatagcgatggtagaaatccaccccaacatgatttggataatcttctccttcgataacgccatcagttaagcgtcttggcgcaccagttacattattccctgctgtttcgacatcagagcaactaattccttttccaccttcttgccaagctccttcagcttgatgtgctgcaattgcaccaccccataaaaaatctttattaaatgtcatctatatcgacctccttatttataaatatattatactacgaaatcaataaagataacggaaataatgataagaatgataaatatcttacataattttctttaattgactttattggatgatatatttattatgtaagtaatggggtgattttatgatagggaaattaacagaaggaaatattaccagggcattaattaaattttcaattccaatgatcttaggaaatcttttacagcagctttataatgtagctgatacttttattgttggacattatatcggaactgatgctctggcagcagttggctcatcttttacgattatgacttttttaacttccattatcttaggtctttgcatggggagtggaattttattttcgatgttctatggggctaaacaattagataaaatgaaaacatctttttttgtctcttttgtaggaatcggcattttttcaattggattagaaatagtttgtcttttagcaattgatctaattttaaattttatgaatattcctagggatatttttacggatacccatcaatatttgtttataatttttctaggtctagtttttacttttatttataattatttttcctcgctattaagagctttgggaaattctaaaatcccattgatctttctagcattagcatcaattataaatattggattagatatttatttagtggcagaagttgcaatgggggtagctggagctgctgttgcgacattgattgcccaagcttttagtgctattggtatcatgctttatgtctttctaagtcaaaaagaattgttaccgcaacgaaaacattggcattttgaacgtgaaatatttgagaaaatcaaagcgtactcattattaacttgtatccagcaatcagtaatgaattttgggattttaatgattcaagggttagtaaatagttttggtttagtaacgatgtcagcttttgctgctgctgtaaagattgattcatttgcttatatgccagttcaagattttggtaatgctttttcaacctatattgctcaaaataaaggagcaggattagaagaacgaatacataaaggatttaaagtagcagttgtaatggcttctatcttttgtatttttatttctgccttagtctttatctttgctgataagctaatgctgatcttcatagaatcttcaaagtctgaaattatctatcaaggggctcagtatctaagaattgaaggtgcttgttatttaggaattggatgtttatttttattgtatggttattatcgtggggttggtaaaccaggaatttctgtagttttaactgttatttcgctagggacacgtgttgttttagcatatcttttagcaccattatttggaactttggcgatttggtgggcaattccaattggctggtttttagctgatttgattgggattatgtatggtttaaaaaaagaaaggtggactaatagatacatcgataagtagaaggaacgacatttaaatctttagaagtcgcctttttagattagaaaaacagtttgctagtaacaggatgttttgattaagaggagcaatagacgtagaaaaagactgttattacaacagtccggtatcaattttaaaagaataaaaatattttcttattaataagtgttaaaacatgccataatatactttgttgcagaagtaatgttctgtaatgagcaattcagcttaagatattataaacatgattactatattagaaaagtaacttttatcttattgtttttagtctagattttctccatttgaagcaattacttttttataccattcgaaagaatcttttttacttctttctaaagtaccattaccttcattatcacgatcaacatagataaaaccataacgttttttcatttcaccagtagtaaatgaaacacagtcaatacatccccaaggggtataaccaattaaatcaatcccgtcaagttcaacagcttttttcatttctttaatatgagcttttaaatagttgatgcgatagtcatcatggcaagaaccatcagcttctttaacgtcaatggcaccaaaaccattttcgacgataaataatggtttttcatatctttcataaaaaatattcaatgcatatcttaatccttctggatcaattgcccagccccagtcagattctttaataaatggatttttaacagaatgctcacttgaaccatcagttgctttagaaacatcttgatgtgcagttgaatctacagtattagtcatataataactaaatcctatataatctacagttccttcagcaaggattttcttatcttcttctgtaatgttaatattaaagcctttgcgttcaaacatttttaaagcatatgcagggtaatgaccgcgacattgaacgtcacagaagaaccagcgatcatgcatcatctgatttgataataccatatcagcaggacgacatgaaaatggataaattggaaccattgcaatcatatttccaatcaaaaagttaggattgatttgtttaccaatttttactgctaatgcacttgctaataaagtatgatgaccgcaaatatacattgcttcttcaggattatcataatctccaaaatgagcaccactattagtccagccaaaaatatcatttttaaaattcatttgattattaatttcattaaaagtcatccaatatttaactttatctttatatcttttaaaacatacttcagcaaatttaacaaagaaatcaatagttttacgattcataaaaccaccatattcttttgctaaatgataaggcatctcaaaatgagataatgtgataactggctcaattccatattttaataattcatcaaaaacatcatcatagaattgtaatccttcttcattgggttctgtttcatcaccattagggaaaatacgagtccatgcgatagatgttctaaagcatttaaatcccatttccgcaaataaagcaatatcttccttgtaatgagaatagaagtcaattccaacatggtttggataatattcattttccatgatttgatcagtaatacggcgaggaacaccatgtgctccggcagtcatcacatcagcaacactatatccttttgaggtatttaaaaccccaccttcaaattgatgagcagctaaagcgccaccccataaaaaatctttacttaaagccatataatttaatcctccttatttttacagtctcattataaccaaaaaaataggttggtacaaatttttttagctaaatgtgttaaaataaaaacgattgtaatagattacacaaaatgtaacaggagtataggaaaatatggaaacgatgattgaatatgtgcataatcgaattaagagaaaagactaccaaattgcaattgattttacaatggggaatggtcatgatactttatttttaagtaaagtggctaaacaagtttatagttttgatattcagcaggaagctttaaataatacaaagaagttgatagaagatactgataatgtaaatttgattttagcttctcatgaaaattttgattgctatgtaaaaaactttgatgtaggaatttttaatctcggttatctccccaatggagatcatcaaattacaactatggcggacagttctttgcaagcaataaaaaaagcagttgaatatttgaatcgaaaaggagaattgtttttagttgtttacattggtcatgatgagggaaaaaaagaaagtttgttaattgaggaatatgtcgccagtttagatcatataagttataatgtagcgttgtttaaaatgatgaataagttatctgctccatacgtaattcaaattgaaaaaagataattatattagatgcaataactaggtaacaatgttataatataagtaattaaggaggtaagcaatatggtaaaaagaatcgacgttaccgtaactgatccagttggtctttatgcgactccagcaaccgaactagttgatactatgaagatgttcaacagtgatattaagttagtctacgcatctaaaactgtcaacatgaaatcattgatgggggttctatctctgggtattccaacaaaagcaaaaattgaaattattgctgatggagaagatgaggacgcagttattaaacgggcccttgaattaatgaaggatctaggaattagtgggtaaaacaatttaataattgggactcttgtcccttttattttgcctattaaacgataatatgatatagtaaagacgaattttataaaaaaggggacatatagatggaaaacttcttaaaactaataattgcttttggaattggctttattcttgttgttctagcaatgcctaaagtaattccattcctacataagatgaaatttggtcaagttgaacgtgaagaaggacttgaatcacataagtcaaaaaatggtacaccaacaatgggtggaatcgtttttgtgattgccgcaattcttggtgcttttattgttaattttaataatttacttgatccggagctgattttagcaacaattgttttagttggatatagtgcaattggatttgtggatgatgctttgatcattgttaaacatagtaataagggattaccgccactagcgaaattattagctcagatcgcgttagcaattatttgttatttctttgcaatgaactttattcctgattttacatcagtaattacaattccattattagatattaatattgatatgggttatttatatccagcattaatcttagtaatgtttgcaggggaaagtaacggtgtaaatttatctgacggtttagatggattagcaactggtctttcaatggttgcgattgcaccatttataatcttttctatcatgacaaaagattatactcttgcaagttatgcaactgcaatggtaggggctttacttggtttcatgatgtttaattatcatcctgctaagatatttatgggtgatgtaggttcgcttggtctaggtggtttcttggctattttagcgatacttacaaaacaagagttattacttattttagttggtggagtctttttaatggaaactttatcggttattattcaagtagtctcatttaaaactcggggaaaacgagtatttaagatggcaccgatccatcatcactttgaaatgttgggctggagtgaacaacaagtaactatttcattctggttcattggtttcatctgtggaatcttatcaattgtaattggggtgctatagaatatgtttactggaaaaaaggtattagtgattggacttgctaaaagtggtaaggctgcgattagattgcttcataaattaaatgcaacgattacggttaatgaagctaaagaaattaaggatattccagaatatcaacaatatcttgatatgggaattgaaatggtaacagggtcacacccaactgaattatttgaacgtgattttgactttgtaattaagaaccctggaattaattatcataagccatttattttaagacttaaggaaagaaagattcctgtatatacggaaattgaattagcttttcaagttgctaaaaaacaacattatattggagtaactggtactaatggtaaaacaacaacagttactttaattgataaaatattaaagggacaatatcaacatgttcatttagcaggtaatgtgggaacaccactatgtgatgttgttttagataatgatcttcttaatgaagaaaatcattatgtagtaattgaaatgagtaactttcagttattagatattgaacgatttaagccttatgtctcaacgatcatcaatttaacacccgatcatttagattatatggcctcattggatgagtattatgcttctaaaacaaatatttataagaatactgatctggatgattattttgtggttaatcttgatgataaaacagtaatggagtatttggaaaaatatccagttccatgtaatcaagtcacaatgtcattgatacatgaagctgactgtatgatcaaagaacaggcaatctattatcgagatgaattaattattaacttagcggatattaaagttgtaggacgccataacattcaaaatattatgacagctatctgcattgctaaaaaatgtgatgtaccagtaacagtcatcaatcgagaaattgcctcatttattggtgttgaacatcgaattgagtttgttagagaaattaatggagttaaaatctataatgattcaaaagcaactaatactgacgctacgatcattgctttaaaagcttttgaacaaccagtaattttattgatgggtggttttgataaagggttagatttaaccgaaatggctacttatggtaataaaatcagtcatctggtgacatttggtgctgctggagagcgatttaaaaatgatatgcatgttgcaaacagtagttctgttgagaatttagaagcagcgactttgctggcaatcgagaaagcaaaagctggcgatattattttactttcgccatcaaccagcagttttgatgaattttctggatatgaagaacgtggtcgagtatttaaaaatattgttaataaattatagaagatgctttgtaaagtgaacctttaaggaatatagcttaaaggtttattttattgtcgaaagtgtcttttttaatttatgaaaaactttctatttgaaaatttcccattatataataaaattatatgtatatgcatggtaacattaaaaattgcaagcttatgggtaatcgtaagttatcttaatgtcgtttcagtgctacctgtttatagataaatattattttataaaggaggaaggcatgaatacattactcagcagattgatagtctatatcaattcatgtgtaaaaaaagatgtgatttacgaaatagcccggtatattattaaaaattatagttattgccaaaatattacgcttaaagatattatggatgaatgttatgtttcgagagctagtgtaacgagattttgtgaatattttggttttcattcttggaataattttcaaagctttttagttaaaacaaaaaaagttaaagaacagcaaattgaaagtcgttttagtaatattgatatagaaagtatctatgatcatttatgttatattgctaaaaatgatagtttagaatttaaaaataatttaaaaaaagagatcaatgcactagttgaaataattaatcaaagtagtagaatttatttatttggggcagtatatccattatcattggcagttgatttccaaataaatatgatcagtattggtaaaacagtttatagtgattttcaaagtgaaagtgattatttagagccaatgaatgaggacgatctagcgattattttaactgcttctggaagatatgttggtgaatgtaagtccaagtttaatttaatttgtaataatgctggcaagaaagcagttattagctgcagtaatcggtatagctcacttcaatacatcaatcattatctctacattccaacgactaataaaaatagttttgttgattttgattattatacgatattgatcttagatttaatttatattgagtataatttaaagtattgtcgagggaaataatagtgggatcaatcttaattaaattacatcaattaatcaattacaatcaaaatgaaaatattcattattcgttagcaaaatatttattagctaattgtgatacgatcaatcgattatcaattagcaaagttgttgaagataccttgatttcaaaaacatctgttttaaaattttgccgttatttaggatatgattcttggaaagtcttttgcagtgattttcaagaagaatgtctcgatgaaaagattcgcttggatcgcttaaagatgaatgcaaacttaatgttttcaaaagataatttaaatgagtatgttcgactaaacgatgaatattttagtgaagtacaaaaaattgttacatttcaaaaaataaaaatattcgctaaacaaattaatgaagcaaataatatctttgtctttggagaacctcgagaattaccgctgttttatgattttcaagaattattggggttatatcataaggaattgatttttcctaaatctttaaataaaaaggattttgaggaacagttagctttgattgatcaagaaagtttaataattattactaacggagttcattcatttgatgggtttattgaaaaggaaactattgaaccggtatatggattagaaagaattatgcaaactaattgtaaagttatttttattggtcaaaagtcagttcaaaattatgataatgttacaacactaacaatacctttttcatttaatgaatattttattcgtttagcaattgctgatttaatttataaaatgattacttattatttttatagatattaaataatttaagaattttataaatagatttattttttttataaatttggtctaagaaaaaatactttttttcacgaaaacaaaaaaggttaaactttatttgtgttttgtcgatgattaagtaaacgctttcatcaacttctcgtttatactagaagcatagggaatttaaacgaggaggaaaatcgaagatgagtaagaagaaaaaacttacaaaaacattggctgctttatcagctgccggctgtattatcggaagtgcaacaccgattgcattaaatgcagtagaattatcaaaatattctgttgtggaagcaaaatatcaggctgcgaaaacagaaggaagcggagaaaacgctcaatttagtgactacgatattgatattatggtagtaactaatcctgattataaaggtgaagcagctccagctttgacttattcaaaagcttttgatgaaaaagctaaagaagctggtaaaacggcgttgttaagcgaaaatatcgatggtaaggaatatgctttcaaagatatgaacttaaatggagaaatcgatgattatgaaagatggtatcttgatgctgaaacaagagcacaagatcttgctgatgcattggttgctgaaggtgaagatgggttcgcaaagattgctggattaatgttatttagtagccatgaaggaaatagtgctgcaggattaacagattcacaaaaagattatttaacaaatagttatgttagaaatattactgatgcagcaggaaatgatgtggaagattcagtacgttgggtcaatgcgatgcaagagtatgtagaaatatctgatttcaatgttcctgttgattttagttctgatcctcgttcaacagcagggtcaggagatttatattctgataatgtttctagtggggttacagatatttctaaatggccttctaatattggattggcagcaacttttgatactgaacatatgtataattttgcaaaggcatcttcagctgaatatcgtgcattaggaattgtaacagctttaggacctcaaatagatttagcgacagaaccacgctggttaagagttggtggaacttttggtgaaaatactaaactatctacagatatggctcaagcttatgtagacggttcacaatcaacatatgttaatggagaagatcaaggatggggaaaagattcaattaactgtatgatcaaacacttccctggtgatggagccggtgaaggtggtcgtgaatcacatacccgtgcaggtaaatatgcagtttatccaggtggtaattttgaagaacatttaactccttttgctcaaggtggcttaaaattgaaagggaaaactggagcggcaactgcagtgatgacatcttattcaattggaatcaatgctgacggtagtgctttaggtggcgaaagagttggttcagcttatagtaagtctaaaatgagtattttaagagatgatttaggctttgacggtgtagtttgtactgactggggtgttactagcacgccccctgaacaattagcactaggtggtctaggaatggcttggggaatggaaaatgctactgataacgaaagacatttagcaatcttagatgctggtggtgacatgtttggtggtaataatgacaataagccaatcgtttggtcatggcagcaaatggttgatcgtgatggcgaagaagctgctaatactcgctttgcaacttcagctaaacgtttactgaaattaacaatggaaccaggattatttgaaaatacttatttgaatttagatgaatcattagctgaagctggaagtaaagataaaaaagacgctggatatcaagctcagttagagtcagtggttatgttaaagaataaagataacacaattaaagcggctaaagatcaagcaaaagatcctaaagatatgactgtttatattcctaaaacatatactgcagaacaaaaaggagtttttggtgatacacctgcatcttggtcagattcaatgaatattgagacagctaaatctatctatggaacagttttaactgatgaaatagttgatgataaagtagtacgacctgatttatcaaatgttgataaagtaattgttggaatgcgttctccaaataacggaagcttatttaatcaatcaggtatgatcgttgaagatggtaaacaaaaattttatccattatcattgcaataccgcccatatactgctgatggcgaaaacgtaagaaaagtgtcaattgctggagatttaaatagtgatggtacccaacaaaatagatcttattatggagcaactagtaaaattgctaatgaatacgatttaacagcttgtttggaagctgtagaagcagctaaagcagtcaataaagatattcctgtagttgttgctttaaatgctaatggtcctgttatcgttagtgaatttgaagacaaagtagatgcaatcgtatgtggcttctctgtaagtgatagtgctgtgtttgatattattaatggtaaatctgaaccaaaaggattattaccattacaatttcctgcaaatatggatactgtagaagcgaataaagaagatgttgctggtgatctagtatgttataaagatacacaaggaaatacttatgatgtagcctatggtttaaactggtcaggaattattgatgatgagcgtgttcaaacatataatccagaccgtccaactacagatacaacaacagttacccctacaccaacacctgataaacctactacttcagtaaaaactggtgatgaaattaatttaaacacaacaatgctggctggggccgttgctctagtggcaggattaactgcatatgtaacagctaaaaaaagaaaagcagtaaaataaaatgataaagatgatatagaggtatggttcagcatacctctataattaattgaggtgagcatatgaaaatacttaaaaaattaatgattttgctagtactggcagctttgataataggttgttccaaagaaccagaaaataattatttaggaaatctgaaagttggctatacaatgaaactagatgataaagaggtgccaaaagcaaaatttgagtttttctatggtcgcgctttgactaaatatttaaaccaatattacagtgcttttagtgatgattatgcaagtatagttgattttaatattgaaaaggatataaatgatttaaaaaatcaagattgtacggttactggttatacagacaaatcatgggaatattattttgctgatcaggcaaagaaagatattttagaagtagaggcattggtaagaggtgctaaaactgctggttatcaaataaatgctgatgataaaaagaaagctcgctcaacatttggtgaactagaaagttattgtaaagaaaataagattgattttgaagattatctccattcaacctttggtttagaggcaacaaaggataatttaatcagttattatgaggaagctaatctggcctcacgatatgcagcagttttattaaaagaaccaactgatgaagaggtggagcaatattatctagctaataaaaatgatattgatacgatcaatattcgctattttgcttttgctaaggatgataaagcaaaagcagatgagtttgcccaaaagattcgtagtgaggcagattttaaacagatggcagttgattatagtagtgatgataaaaaaatttattatcaaaataatgatttgagtctacgtcaagatttaagaaaatcagatttacctgaatatttgcaatccgtattatttgatcaggcattaccaattaatagtgttaaagtagttgaaggggattctagtattgatgtagttatgctggtggctagagaacagcctgtttatcgacaagctagtatttcaacagtttatttagatgctagagaaacagatactgataatttgacaaccgaaaaaatgaatacatgtaaagaatttgcagacaatttgctacaagattttatgaataatactgacagatcgattgataagtttcatgaatataatagtaaatatgcagatgataagaacaatcagggagattatgacaatatatctaaaggggatagtactattgaaattgcaaattgggtttttgatgaatctcgacaagttggagatttggaagtattaatgagtaattatggttataccattgtatattttagaggatttggaggaattgattattttgaaagagcaaaggtattagctaaagaagcaacgtatgataagcagttaaatgatttaaaaaggaatatcaaggttatgattaaataaaaagtttatcaggaatgataagctttttttcatttcttaaaatattttttcatatacttaaaatggaggtaagtatatgaaacgtagaagagtggtcgttacagttttaataattgtgataattgggttgatgatggtatatagtgcctcgaatatttgggccggatataaatttaatgattctttatattacattaaacgacaaggaatttttgctgttattggtataattgctatgtttgtgttttcaaagattgattatcatatttatcaaaaaaatgcaaataaacttttgattgggtcttttatcttgatgattttagttttgattccggggattggagcagttcgcggggggtcgcgctcatggtttaatttaggtattatttcgttgcagccatctgagctgtttaaaattgcgataattatttatagtgcaaactatattaacaatcattatcatgaattaaagaaactaaaagctagtttgaagttgttattgattttgggacttgggtttggtttaattatgcttcagcctgattttggcagtggtgttgtaatggcttgttcaattgtagtgatgttgatcgttagtccatttccatttaaatattttgttatgttagggatcttaggggcaattggaatcgttattatgattatttcggctccatatcgtttagcacgtatcgtagcttttttaaacccttttgccgatcccttaggaagtggtttccaaattattcagtcactttatgcgattgcaccagggggaattttaggagtaggctttaataatagtgtgcaaaaacatttttatttaccggaaccacaaacagattttatttttgctatatttttagaagaatttggattgattgggggcgttttattagttggaatgtacggttatatgtttgtaactgtctttaatcaagcaactaaagtaaaagatttatttggcagctttttaatgattggaattatttcaatgattggaattcaaactttgatcaatcttggagtagttgtcggtttatttccagtaacgggagtaactttgccgttaatgtcttacggaggatcgtcattgacgattacgcttattgcaattggaattgtattaaatatttcaaaatcaacatattaatgttatactagtgtctagaggtgagatgatgaaagtaatagttggagctgggggcacaggtggacacttataccctgccttagctttagttgaatatataaaagaagtagaaccagatagtgagtttctttttgtaggaactaaggatcgtattgaatcagaagtagtacctcaacaaggctatgaatatattggtttaaatgttcgcgggttagttggaaatcctattaaaaaggggattgctgctgctatttttgttaaatcaatttttacagcgaaaaaaatagttaaaaaattcaaaccggatattgtcattggttttggtggttatcctagtgctagtgttgttgaagctgctaatcgcttaggatataaaacaatgattcatgaacaaaattcaattattggtttaacaaataaaattttaattaaaaatgttgataaaatcgtatgttgttatgataaagcatatgagaattttcccaaagataaaacttataaattagggaatccacgtgctagtgtaattgcctcaatcaaaccagatgatatttttaaaaaatatcatctaaataaaaatcttcctttagtgactattgtaatgggatcattgggttcaaaatctgttaacgaaatgatgttaaaatcattaaagacttttgaacaaaagaattatcaagtgctttatgtaactgggaagccttattttgaagagatgaaaacaaaattaggaaagttaaataagaatattaaattagtaccgtatattgatgatatgccatcagtattaaagaatacaaccttggttgtttctcgtgctggtgcttctacgctggcagaaattacagcggtagggatcccagcaattttaattccaagtccttatgttgccgctaatcatcaggagtataatgctcgagaattagctgatcgtaatgcagcaatgatgattttagaggaaaatcttaatagtaaagattttgtggaaaaagtggattatattttagagaataaaattgttcaagagagtatgcaaaaaagtgccaaggctcttggtaaaccaaatgcatgtagagatatttataaattaattaaagaaatgtaggagtatagaatgaaattttctcaagttaaagaagatttagaaaaattagatgttggtgagatgattgaagatgagccgatgtataaacataccacttataaagtcggaggaccagcgcgtatttatttaaaagttaaagatgttgatagtctgattaaaacaattaaatattgtggtaagcatcgggttaaatatttagtaatcggtcggggttcaaatttattattctctgatcgtgaatatgagggcttaattatttctctcaacgaatgttttaatgagattaaggtcaatggttcgacgatgattgctcaagctggtgtaccaatgatttcattatcatatcaagctgctaaaattggattaagcggttttgaatttatgggcgggattcctggctcaattggtggtggaatatatatgaatgctggagcatataagtatgacctggcaagtgtagtaaagacggtcacattattaaatgaaaagcatgaagttgttacttttaataatgaacagatggacttttcttatcgtcattcaatttgtcaagataatcgaaaattgattgttttggaagtaacgtttgaattgactgctaaaagtcctgatgagattaaagctgttttagataaacgtaaggaacgaagaatgtcttcacaaccttggaatatgccaagtgccggaagtgtatttagaaatccgcaagataaaccagcttggcagtatattgatgaatgtggcttaagaggctatgaaattggaggagctcaagtttcgccaaaacattctaattttattgtaaataatggctatgccagtgctaaagatatttatgatttgattatgttagtacaagagaaagtaaatgaaaaatttggagttaagttaagacgtgaggttggattgattaattgggagtagtgtatggcaaaaagaaagcaacaacagaatatatataacgattatgatcgcgatcaagttcttgcttatttaaagaaacaaaaggcaaagaagcgaaaaaggcgtcgacgtgtcatttttgtaattttagttataggattgattattgctttttttgtcagtgattatagtcgtttacagacaataactgttagtggtaataatcgtgtgagtagtgaagaaataattaccgcttcaaaaataaaactgcatcaggattatactttctttaaaagtatggatgcagctgaaaatgccattaaaaaaacatcgctaattaaggatgccaaggttacaaaagatttatttggtcatgttaaaataaaagtagttgaagctgacccgattggtcaatgtacgattgataatatattgtatgttgttgatgaaactggccgtgtaactaaagatgaggctggagtattaactacatatgtacaacggtgtccaaaattaaatggttttgattatgatcgctttgcagcttttgcaaaggaatttgcaaaaattcccgctcaagtagttaatcaaatttcagatattaattatgcgcctgaaaatcttgacgataaacgttgtgaatttatcatggatgatggtaaaattctatacttgcgatatgatgatatggcagtacaattaaagggcgataattatgctttaaagatggaagaattcccagattataagtattatgattttgtcgggaagtatgtttatgttcataattaattttttctacgggattgcttaaaggagtttaaaaataactgtttttatgctaatattgtatatatactaagaaaaggggatacgtgatgaaagatatttacgctgttttagacatcggtagtgcaaccttaaagtttcttgttgctgaagtaaataacattaatgtcaatgtactgtttgtcaaaacgattcctagtcacggagtgaaaaagggaattatagaagatgatcgtatcttaattagagatatacgaaaactgattgatgaagcagaggcttttctagaatctaagattacgagcgtcgctttaacaattccaaccataaaagctaaattatatcaaagtgacagcagcattagtttatcagatgctgggtctaaagtatctactgatgatatagttagagtattgcgtttgtcatcaaaatttaaacgttctaaggatgaagaagtagtatcaattattccagttcgctatcatagtgataaaggagcaaccgttgaggcgcctttaggggaactttcaagaaatttgatcgttgattctttagtcattactactagtaaagagttgctttacccatatatttcggtagttgaaaaatgcggtgtggaagtacttgatattactatcaatgcgtttgcatgcgcaaaagaggcttttgatgcagtatatcttcaagaaggtgctttattgatagatatgggttataagacttcgacagtttcattttataaagatggatatttacaatacttgacagtttgccaagtaggagggtatgattttactcgtaaaattgcccaaaatatgcagatatcaatgaatcaggcagaagcttataaaattaaatatggttcattagatgtaacacaaggtcagaatgatattattcatacaacctttgttgatgaacaaaaacgtgattatacacaacaggacttggctgatttattaaatgaaacagcttatgaagtaatgaataagattaaagaaaagatttcagttattgatgatattagtaaatatgaaactttaatcgttggtggtggtggagagctggaaatgctggatactattgctacagaggttttagaatgtcccgttcgaatctatcgtcctgatacgattggaactcgtgatatgtcattagtagctgcaattgggatggtttattacttaatggaaagaaaacaggttgttggtgattatacaccttcattagtattgccggatgtgacaaatacaatggcaattagatttaaagggttgacaaagtcagcgccttcaaaacaaggaagtaaaatgtcaaaactattagattcattttttagtgaagattaatataaaaagagaggatatattgtcatgagtgaagaattaggatttgaacaagtagcacgaattaaagtaattggtgttggtggtggtggtaataatgccgtaaaccgcatggtagaagagggtgtagctggagtagaattttatgttgcaaatactgatttgcaagtattaaaacgttctcctgttactaataaaattgaattaggtagagatttaacaaaaggtctaggagctggtggagaacctgaaattggaaaaaaagcagctcttgaatcagaagcagaaattcgtcaagtgctagaaggtgcagatatggtttttatcgctgctggtatgggtggtggaacaggtactggggctgctcccgtatttgctaaaattgctcgtgaattaggtgctttaacagttggggttattacaaaaccatttacttttgaaggaatgaaaagaaaaaaacaagcaatctcagggattgaagaattacgtgctaacgtcgattcaattattaccgtttctaacgatcgtttattacaattgatcggtggacgtccaatgcaagaagcattcagagaagctgataatgttttacgtcaaggggttcaaacaattactgacttaattgctattcctgcttttattaatcttgactttgctgatgtttctgcggttatgaaaaatcgcggtaatgctttaattggaattgggatgtcttctggtgatgataaagcgaaagaggctgcaaaacgtgctatttcttcgccattattagaagtgtctgtagcgggtgctaaagatgcaattattaatgtaactggtggaccaaatatttcattatttgatgcaaatattgctcttgagacgatttctcaagaagttggtgatgatattaatacatatttaggaattgcaatcaatgaaaatttagatgatgatattatcgtcactgttattgcaacaggttttgaagaggaaaacgatgatgattttgaaccacgtccaaacgttttaaaaacacgcagtgttgaagatgttgtacctttatcagcgcgttttgaagatgaagaagacgatgatgacggtgattttccaccagcatttataaaaaatagaagagtttaattaataagctaactaaggttagcttattttgcaaagggggataatttagatgaaaaaaataggatttattggtatgggaaacatggccggtgctattgctggcgggattattaaaagtggttttgttgaaggtgaaaatgtttatgcattcgatatagataatgataaactaacaaagatgcatactgatttttcaataaatgtttgtactagtgaaaaagaattagttgctatggctgacatagtgataattgcagttaaaccaaatgttgttgaagatgtagtcgctaaaattacagacgaattagataataaggcaattatttcaattgttgctggttacgataatgaaatgtataatgaattgttattggattcaacacgacatttgacgatcatgcccaatacaccagctttggtaatgaatggaatgactttatttgaacaagaaaatacgctaactgcagatgaactaaattatgctgttgagatgttttcaagcattggagaagtagtaattttaccaagttatcaaatgaaagccggaggaagtattagtggttgtggaccagcgtttgtttatatgtttattgaagcaatggcagatggtggggtacgcttaggcttaccaagagatgttgcttatagactagctagtcagactttaatcggtgctggaatgatgcaaaaagaaacacagttacatccaggtattttaaaagatcaagtttgttcgcctggggggatcactatcaaaggggtcgaaactttagaagaaaatggctttagaaatgctgttttaaaagcaattaaagaatcaaattaaaatattaggatcgcaagatccttttttcttttcttgacatttttttgcttagataagcgctatgatagttaggggtgaaaagatggaggtatatattgaactgacgtatctaacaaactatttaattattttggttgctttggaaatgatggcgattttaattagtaaggaaatgtcgtatctaatggttattaaacatagcttttacttaagtggagtaattttactattatacttagatagttatagttggttaattatattgatctgggcagttgtttttttatgtctatatcaacgccaaatatttctgtattatccaatttttatttttgtttatttttcattattattattcgctagttcaataattccagaagcatttatttataatggaatcttaatttcaccagtaaatgttagtagcattggtttatttattgttagcttgctcgttgtattgatgcagattatgtttattgtttatttaaaaagaaaaataagaattgatgactatttatatgtaatgaaattggattaccagcaacatagttatacaattaaaggatttcttgatagtggtaatgaagtttactatgagggttttcctttaatcataattaatcaaaaaattattgatgagtatgaagtaatcgatgttttagaattaaatgatttacgtgaagatattattgaaataatcaaagttgatcaggttataattaataatcagagattacaagatatctatgtcggggtgattgccgggatacaatatgattgtttattaaataaatcacttatgggaggaattttataatgataaaatttattttaaaaatattaaataaaactaaatatctttattatattggacggcatgatatcttaccaccaccattaaaaggtattgaagaaaaggaagctttagaaaagttgggagctggtgataatgatgctcgagatttgttgattgagcataatttaaggctagttgtatatgttgcaaaacgctatgatacgacgcaaaatggtggaatagaagatttgattagtatcggaacgattggtttagttaaagcaatcaatacttttaaacctgataaaaatattaagttagctacttatgcatcacggtgtatagaaaatgaaattttgatgtttctaagaaaaaataataaattgcgtcacgagatatctttagatgaaccattaaatattgattatgatggaaatgaattgttgttatcggatattattggaacagatagtgatattgttaaaaatgaattggaacaaagtgatcaaaaagcaatgttttatgaggcttttaaggatttatccaaacgtgaaaaggaaattttgatgtttcgttatggtttaatgaattatgatgagttgacgcaaaaggatgttgctaaaatgatgggaatttcacagtcatatatttcacgattagaaaagaaaataatcaaaaaattacgtaataaattaaattataatgaaataaaataagtataaatttgtcatatttgctaaaaatagagttgaaagaaggcaaatatgagtaattatcaagttattataaatggttatcaagaaccgaaaaaaagacttacaaccgatgaaacttataaattgatagacgaataccaagctactaaaaacgaggcgataaaagacagattagttaacgataatactaagttagttttatcaatggcaagacgtttttatggtcgtgaagatagcatggatgacttatttcaagttggaatgattgggctgattaaagcaattgaaaattttaacactagttttggtttgaaattttcaacatatgcagttcctctaataattggtgagatgaaacgttatcttcgtgataaccatcaaatcaagatttctcgctcaattcgagatttagcgtataaggttttaaaggttaaagatagctatataacaaaattaaatcgtgaaccaacgataaatgaattagctaatgaactggaagttgagccaagtgctgttattgaagcgctgttatcaacaaacagtgtttcttcattacaagaagaagttaaaaatgatgatggtaataatttaaagatgattgattcgattacagatgataaaacagttgtatcaagaacaaatgaaacaatagatttatatgatgctttaaaatcattaaatcaaaaagagcatcgtgtgattaaacaaagatattttgaggggttgtcccaaagtgagattgcaaaggaattatttatttcccaagctcaagtgtcaagaatcgaaagaaaagctttagataatttacataattatctaaaataagcatatatattaatggtgattcgatgagatttgtaaaactgcagtctaaagacgtgatcaatgtcgttgatggctgcaaaattggttttatcagcgatattgaaattgactggtgcggtaaatgtatacaggcaattgtagtagagaaatatagcttttttaaactattatgtttttttaaagaagcaccatgtattgttattccaattgaatgtgtagtgagcattggtggcgatgtgattcttgtatcgattgagccataatagtcaaatgtttaagcatttgactattttaataaaatcttttaaataaccagcagtttgttgagtaattatccttttatggacggatttattgtgctataatatactagtaataaattaaggaggaccacttcatgggatacggacaaaaagtaaaaaaatggttttttgacgaagacggtgacgaagttgaagaatatgaagatgtagagattgatacagaacctaaaacaagcttatttgagcaagcaaagttttctaaaacaagtgatgcaatcaaagctttaaatgcaaataaagatagccaattaattttatttgaaccacgggcatttgcagaaactcaagatattgcaaatcatttaaagcaaaagaaagctgctgttgttaacttgcatcgtttacaaaaagaacaatctaaacgagttgtagattttttaagcggagttatctttgcaattgaaggagacatccaaagaattggacctagaatattcttatgtactcctaaaaacattggtgtttctgggacaattgatttagatgaagatgaatctgaagaataatagataagtattagcttagctaatactttttaattatgatagagcattttaaaggtgaagaagtttttgttaaaaaggtattagagtttaaagatcaagctctatataaacaaagacttgttttaactaaatttttaaatccatatcatcaatcaattgtttatagcattgtagggaatcaaaatgatttgattgttattgaagatggtggaatggttgatagtgaaatgaaacgtttgattattgcaccatcattttatcaaattgaaaaagaagattttgaaatagttttagctaaaataagttatgcaaaaccatttggtacattgaatcatcgagatattttaggagcattaatgtctttaggggttaaacgcgaattatttggggatatttatgagtatgaggataatttttatgttgccatggatgcaaaaatctatgagtatgtaaaaaataacttaattaaaattaaacgtagtaaagttaaaattttagagagtgaagagattattacaattaaacatcaatatataagtaaaacttttattgtctcctcatttcgtttagataaagttgtttcaactttatatggagtgcctcgaagcaaggctgtcagttatattcaatcaggttttgtaaaagttaatcataaagaagttgaagaaataaattatttgtgtaataatagtgatataatatcgttaagacgtcatggaagagttaaatttgtcgatactaaacgacgaactaaacaggataattatgtcgttgaagggtatttttataagtaggggagtgagacgatgagtgaatttaaaaagcaatttaggggctatagtgttcaacaagttgatagtaaaatagatgattatcaagctgagttagcatcactaaagcagcaagttgctagtttaacagatgaattagatcatgttaaagaacaaaactcgctattgcagcatcgtgtcaatattaccgaaaaaactaatgaagaaattgctcgtctagccttaaaagaagcaagtgaattgattgataaggctaaacgcaatgccaatatgatcttaaaagaatcattggactatgttcgtagtttatctagtgagatgaatgattttaaagatcaggcaattaaattccgttcatcggttcaaaaaatgtcccaagatattttggattcaatcgataattcggaagtctttaatcttattaacgaagaagatgaagataactaaatacgatgaaagagacagtttatagtaagatgtttgtagagagctgatggatggtgaaaatcagtaactattattataatggatcactcgggagtagcaccttgaaattagtaggggttgccgttaatcgcgttaagatgtttgagtgcgtattggaaaatacgaattaaggtggtaccgcgaattattcgtccttttattttgaaaggacgttttttaatttatttggaggaaaagaaatgaactataaggacacactattaatgccaaaaactgagttcgaaatgcgtgggaatcttcctaaaaaagaacctaagtatgttgaacgctggcaaaaagagaacatgtacgaaagagtaattgagcaaaacaaagggaaagaagattttgtttttcatgatggtccaccatatgccaatggtaatatgcatatgggacatatgttaaataaggtaatcaaagatgttatctgtcgttacaataatatggagggacgctatacgccatatattcctggttgggatacgcatggattaccaattgaaaatgcgattcaaaaattaggggtaaatcgtaaagaaatgtctacagcggcttttagagaaaaatgtgatgaatatgctcatgagcaagtaaataaacaaatggaacaattaatcagaatggggacatttgctgattataaacatccatatttgactttaatgcccgagtttgaagctaatcaaattgatgtatttgcaaaaatggcaatggatggattaatttttaaagggttaaaacctgtctattggtcaccatcaagtgaatcagctttagcagaggctgagattgaatatcatgatattaagagtccgactatttttgttaaatttgctgttaaagacggtaaaggaatcttagatactgatactagctttgttatttggacaactacaccttggactattcctgcaaacctggcaatttgtttaaatgagcgttacgattatgcactgattgaaacaactaaaggaaaattaatcgttctaaatgaattagttgattcattaatggaaaaatttgaaattactgagtataaagtaatcaaaaactttaaaggtagtgagttagaattaatcacttgtcaacatcctttatatgatcgtgaatcattagtgatcttaggtgatcatgttactgctgaggcggggactggttgcgttcatacagcaccaggattcggagcagatgactttttcgtcggacaaaaatatggtttaccagcatattgtaacgttgatgaacatggatgtatgatgaaagactgtggtgaatggctagaaggtcaatatgtagatgatgcaaataaaacagttacaatgaaactagatgaattaggagttttattaaagcttgaatttattacacatagttatccacatgattggcgtactaaaaaaccaattatttttagagcgactgatcaatggttctgttcagttgataaaatcagagagaaattattaagtgagattgataaagttaactggttaaatgagtggggacatattcgtatttataatatgattaaagatcgtggtgactggtgtatttctcgtcaaagatcttggggagtaccgattccaatcatttattgtgaagatggaacaccgattatggaagaagaagtttttaaacatatttctaatttatttagaaaatatggttcaaatgtttggtttgaacgtgatgaaaaagatttattaccagaaggatatataaatgaacattcaccaaatggtatctttaaaaaagaaaaagatattatggatgtatggtttgactcaggttccagccatactggatgtatgattgaacggggatatcgttatccagttgatttatattttgaaggtagtgatcaataccgtggctggtttaactcttcactgattgttggaacagcagctcatggttgtgcaccatacaaaacagttttatcacatggatttgttttagatggcaaaggcaataaaatgtctaaatcattaggtaatactgttgatccaattaaattagttaaccaatatggagctgatattgtaagattatgggcaacttcagtagcttaccagcaagatgtaagaatcagtaatgatattatgaaacaaatttctgaaaattatcgtaaaattagaaatacaatgcgtttcgtattaggaaacttaaatgattttaaacaagctgatctggttgcagttgaagctttggctgatgttgataaatatatgctagctcaattaaatgacttgattaaaggatatcataaagcttatgataattatgattttgctgaagcaaatcaattaattttaaattattttactaatttattaagctcattctatatggactttactaaagatattctttatattgaaaaagccgatagtcttcgtagaagacaagtccaaacagttttatattatcatgctaaagcaatgatgaaattgatttcaccagttctagtatttactgctgaagaattacatgatcatttccattgtgatgataataaggctgattcaattttcttagaacctaatgttgaaatgatcaatatgcctaacagtgatcaattaaaagctcattttgatcgtttcctagagcttcgtaaagatgtcatgaaagctttagaaggattgagaaatgaaaaaattataaaatcaaatatggaagcaaaagtgacgatttcattaaaagatgaatttaaggaaatggcttcaatgcttgctgacttaaaacaattatttattgttgctaaagttgagttagtgaaagattcttcgttagaagaatttgatagcgcttatatcaaagttgaaaagttcgaaggtcatcaatgtccacgatgttggaactattttgatgaagatgaaatggaaggcgaattgtgccctcgttgtcatgctgtaatcaatggatagataaaatctctaagtttaaataagtatagctaaaagtaatcatataaattggactgcatctctgatcttggatagtcaaggatgactgttcgatttagattactttttttattgcaatagttattactaaaatagaaaaagtagctgtttaatggggttttattaaataaatattgttgaaataggtcgaaagtgttaaaataaacaagtatgtatggagggttcaaatgaaaagtgataaatttaaagggtcatttttgttgttattagcagccttgatttgggggagttcatttattgttatgaaaagtgcagtggatttcttaactcctaatgtcctgttatttgttcggtttacattggcaacattagtaatgatcataatgttttataaatatattaaagatacttgtattcgtgatttaaaagggggtgcgattacaggaacctgtttatttttggcttatttgatacagacattaggtctgacaatgacaaccccagggaaaaatgcatttttaactgctatttattgtgcaattgtaccttttttagtttggttattctatcataaacgacctgataattataactttgttgcagctttactctgtgtatcaggagttgctttagtttctttagatggtgatttgacaatgaatactggtgatcttttaactatttgtggaggatttttttatgccttacatatcttggcgataaaaaagtattcacaagagatgcatcctattaaattaaccacactacaatttggaatgactgcgatcttagctttgtttggttcattattatttgaagatattacagtgataaaacaaattgacagtagtgtgatcttgcagattggctatctagttttttttgctactgcgctaacattactatgtcaaaatattggtcaaaatcttgtgagtgagtgtaatgcagcgattttattaagtcttgagtctgtatttggtgtaatattttcagttctattatatggagaagtacttacgttaaaagttattgcaggatttgttatcatttttgttgcaattattgtttctgaaacgaaactatcatttttaaaacgaagtaatgtcagggaggaagaattgaatgtgtaaaaaaatattatcgtttttattagttggaatatgcttaatagcaacactaacaccgataagagctttagaaaatagtgaagatattgggcttacttgtgattatgcagttgcaattgatgcaaaaagtggtttggttttatataataagaacatggatgaacggatgtatcctgcgagtatgaccaaggtaatgaccgttattcttgctttagaattaatggatgatatgaagaaaacaacagtaattacacaaagtgatattgatactgtatgggaaactggagcttcctcagctaattttgaagttggagagacagttacatatgaagatttattatatggcgctattttaccaagtggggcggatgcaactagagctctagcaaataatttatgtggaagtcaagaggcatttgttgataaaatgaatgaattagcacaaaaattaaatttaaaagatactcattttgtaaatacgaccgggattcatgatgaaaatcattatactacagttcatgatatggcattaattgttcaatatgcaattcaaaatgaagattttaaaaatatatatgctcaacgttataaaacgtcttcaaatggattacatcaatgggttaataaatcgatgtataatgctaaacgagcaaaaataaatgttgatgatattcttggttgtaaaagtgggtatacaaacgaggctaagagttgtctatcaagtttaaatcgggttaatgataatgaaattattaccattgtaggtcatagtgttaataatgatgttaaaactcatgctgcagtaagtgatactttagatataatgaattatgtggggcaacattattcattacaaagtattttaactaagggtgctaaagtaagaacgttagatgtaactttagcaaaggacgaacaaaaaatagctattacaaatttaaatgacgttagtgcctttttaccaaatgattttaataaagatgatttagaatataaatactcatttaaaaaattagaagcacctgttaaaaagggagaaaaagttggtgatttaaaagtatattatcaagacaaattattatatcaagaagagtatgctactactaaagaaattgaaaaagatacttttagttacatccttggagtagttaaagattttatgtttccatatggtcttgcgattattttagtaattatttatatactgattttaagaatgaaaaaaagatgagaaattaaatttttatgcatttacttgagtggaacataaaaacagtacaagaaattgtactgtttttatgttccaatatgtgtttataaaatcaaaggtattaaaagtcattttaatgggataaaaagtgtattttaaaagcaaaagacagtatagaatcctacactgtctaaattgattttatttattcattaacattttcaaatgcttgaggaattaatggagttggttttttaattcgatgattataaaccagaatggttaataaactgcaaataataataattcctacaaatacaattatttctgtattcaatgaaacatttgacatactaataacttttctgaagccatcaacgctatatgtgaatggcataaaaggatgaattgctttaaaaattgcacttgatgtttctagcggataagtaccggccgaaccacccaaattaataaccataaagactaagagtacaaattcaccaattttaccacacacaatacttaacaaggtcactaatgccattgaagccgctcctacaattacagcaaagataaaagtcattagtaactgttgcggagcaaaatcacagaagaacatcaatgatgcaatcattacaattgaagcaattgtagatactgtaaaccagactgaagctttagataaccaatatttaaagccgctttctgctttttcaacatcattgaataatggatacatcaacgtaaatgccatacaagctacatataaacctacactcatcatatatggagccattccatgaccattgttttcaactgttgaaatttccttatgagaagtatctacaggactagcaagcatatcaaatgtgctgtcgttactgttaatactatttacctgctctgcaccatcatgaagtgaagtagctaaagtatttgcgccgtcttgtaaggtggttaacccagttccaagagtagttgatccagctgctaattgtccagcgccgtcactgatttgattagctccatcggctaactgatcagcaccgctgagcaaagttggattattgcttactaaagtactagtaccatcagctaattgttttgctccttgatcaagggcaccgataccgttagttagagttggtgtttggctagctaattgagaagtaccagtttttaatttattggcaccatctactaaagaacttgaattatcatttaattgagctaagccactattgatttgacttgttccagcaagataacttttaattccagtttttaaacttttctctgtgggaatagtagttttactaccatcagtgttagtatattcaccaccactaattgaagcatcaagattatttaaaccagcttgtatagttctactagcagttgctagacctggggtagttgtatcaccatttaaggctgtattcatcgtactaagactagaactcatctgctgaaccaattgatatgaagaaggcaaagcatcagttacaccaaactttgttaatccgtattgttcaacttcttctttacttagacctgtatccaaaattgtttgtgctagctttttatagtctgcattaccactattttgaagtgtattgattaaggtagtataatttgataaagaaatactagatgtttttacttgtgaagccatttgtgttaagccatcactgatttgctggttaccagcttttaattgacttgccccggctgcgagagtatctacaccattacttaaggtagaattattgctaactaaagcttgagaaccttgataagcgctagtaacaccgccagtatattgacttattccagtttgaagttctgtggctccattatcaagttgatttattccacttgataatgcaggagtagcgttgtttagagaattgataccatcctttaatgaatatacaccattatttacagttactacaccatcggtataatcttgtaacccgtttgtaagggtagaagccccatctttaaaagtgattgaactagttgctaatacttgaagattatccgaaatagttttattaccactaattaactgattagccccatcattaatttgattagaaccattagctgcctcactcatgccgcttccaactgttcccaattgattgaaaatagtttcagcataagtcttagttacggttgaagaaacttcagctttgattttagcaattgctgaatcatccattttagaagcaatgtaactgctgccaggattagtagtatagtttaaaatcattttttgtggttgggcatctaataatgtcgttgcatttttagaaaaattactaggaatagtaattaccatataataatcaccgtcttttaatccttgatcagcagttttactgtcaaccagtttaaaatccattgaatcattgttttgaagactttttgctaactctttaccgacatttaaagtggaatcattatattcaacctttttatcctcattaactaccgctacgggaatttctttagtatttccatacggatcccatattgaccctaagaatacccccgcataaatacttggaattgcaatgatggctacggccactattttcagccaccaatttttacgaaatgctgaccactctttttttatcattttttctcctttccattaaattatagttttatcttgaaatttaatatattaatagatataatctatccatggataaagtttatctattaataaagcatattttaatcatctactataagtttgtcaatcaatttataaaaaatattttctagattattaatctcgaataatgttacaatatatagcaaaggggaaatgaagtaatgaaagtaaaaaatagtgtcgaacaagcaatttgtttattaataattatcgcccatagcaatgatgaaaaacctttaaaaagttataatatctctgatagtttaggtgtttctgattcttatttaaaaaaaattattaggcaattagttgtagctgggctgattacatctgaagcagggaaaaaaggtggtgtatgcttaagccggaaacctgataagattactttgctggatatttttgaggctatcgagggtaaagagccgtttgcaaaagcaacgggactagtagaacgtgtttttgttaatgaattaaaagaaatcatggatcaaaagcaggcgatgattttagatgcatttaatgctgcagaagcaagttataaagaaaaattaaaaacgatcacattaaaaatggctatggtagaacgaaaaaaggattcttaagcgaatccttaaatattaaccatgctttttttgattgtttttatcgacaattcgatctaagccatatccaattacacgtccaataaatgcaaatacgataaaccagagtgcgctccatgaacttgtttctttattaacaaagccaataacaaaaataataactgcaatcgttaatccaacagctgtacctaatgtcataaatacactacttttttctttcatcctttcactcctcaattctaaattataccacaacaaagtgcgcatacaagtaaaatatgtgttataatactgtcgtaaataatggagtgataagatgataaatacaattatatttgacttagatggtacattgatagattctttagttgatcttgcaaatactgttaatgttattttaacagaaaaaggatatcctacgcatacccttgatgaatatcgttattttgttggaaatggtgtattaaaattgcttgagcgggctttacctgctgatcatcagggggatattacagctgtaaagaaacgttttgatgaaatttatggtgaaatttgtttagaaaataccaaaccatatcctggaatcacaaaattaattaatactttggctgatcaaggatataatttggctgttgtgactaataaaccgcaagaccatgcagttaaaattgttaagactttatttccaggatgttttaaatatattttcggtagtagtattagacatcctaaaaagccggatccctgtttaacaaatctagttattaatctttttgatgtgcgtaaaaacgaagtcgtctatataggcgatagtgacgttgatattttaactgcaaaaaatacgaaggttagatcaataggcgtatcatggggatttagaggacgtcaggagctgcttgaaaatggtgcagatcttgttgttgatcatgccaatgaaattaaagaggctataaatgattggtgtaagtagttgtctagcaggatgcaaatgcacttatagtggtgatgataaattaattaaattagtcaaagagatggttatgcgaaatgaagcaataatgatttgtcctgaagtgttagggggattgagtattcctcgttctccttgtgagataagagatggaaaagtagttgatattaatggtgttgattggactaaggaatatcgattaggagcacaaaagagtttagaaatattacaagaacatgatgttgatgtagttttgttaaaggcaaaaagtcctagttgtggaaaaaactatatatatgatgggacgtttagtcataccattataaatggtgatggtattacttgccaactactagaaaaacatggcataatagtattcaatgatgataatattgatgaatttttaaaatacatagaaagaaggtaaaaaaatgggacacgtattaaaaattaatccagtttttaaagaaatgatttggggaggtcataaattaagagatgtttatggctatgatattcctagtgacaatactggtgagtgttgggcaatctcagctcacaaaaatggagattgtactattagtgatggagaatttgctggaaagacattatctagtttatgggatgaacatcgagagttatttgctaatattgaaggtgaccaatttccattattggtaaaaattattgatgcttgtaacgatttatctgttcaagttcatccaaatgatgaatacgctaaagctcatgaaaattctttaggtaaaacagaatgctggtatgttctaaataccgatgaaggaacaaaaatggtaatgggacaccatgctaagactaaagaagagttagtaaaagcgattgaaaatgatgactacgacaatctgttaaataaatttgatatcaaagaaggagacttcttctatattccttcaggtacgattcatgctatttgcagtggttcattaatttatgaagcacaacaatcttcagatattacatatcgtgtttatgattatcatcgtaaagatgctcaaggaaatgaacgtcaattgcatgtacaacaatcgattgatgttgcaacagttccatatgttccacttgcggcggatagtatggttgaaacagcaattgaaaatggaacgaggacgaagttggtatcaagtgaattttttacagttaataaatacgaaatgactggtaaaaatacgattgttaatgataaaccattccaattagtcactgttattaaaggtaatggtgttattaatgggaatagtgtaaaaatgggcgataactttgtagtttgtgctgatcaagatgccgtagaatatgatggtacaatgacagttatgatctgtacattataatgtattgttcgaactgtaatcatgaatttaaagcagcttcttttgcctataaagcaagacaaagatgtcctgagtgtggaacgttgatgcaaatccagtttccttcgggaatggggttcattcctatcattgttgcaatacttccagcagtatatatggtttcagtactgcaatttgatttattggttggattaagtgtctttattcttgtttattggccaattgaagttattatgaatatcttattaatatattttgataaataccgcctatatgaagtagatcagtgatctactttttttgaacaataatgtaataaatcattggcggaaataatgactaaatgggaactttgtgatagaatgttgacgataacgattaagtgaggtaaattatggcacatttgaaatttaaatttgaaacattaaatgctttttgtaatgaagcatttgaaaaattcggttttacaagtgatgaaagcaaaacaatcacagatgtattattattgtcagacgtatatggaattgagtcacatggtatgcagcggctttcacggtatcacaaagggattgaaaaaggcatgattaaggttgatgcaaaacctgagattgtttttgaaacccctgtttcggcagtgattgatggtcatgctggaatgggccaattgattagtaaatttgcaatggaaaaatgtattgaaaaagctaaaacagtagggatggcaattgtaacggtaagaaattctaatcattatggaattgctggttattatgcaaaaatggcttgtgacgagggattaatggggatgtcatttactaactcagaagctattatggttcctacttttgcccgtaaagcaatgctaggatctaatcctattgctttagcaatgccagctaaaccatatccattcttttttgatgcttctactacagtagttactcgtggtaagttagaaatgtatcgaaaagctgaaaaagaattaccaaatggatgggcactagataaagatggtaatccttctatagatgcaccagatgttttagacaacattgctaataaaatcggtggtgggattatgcctttaggtggttcaacggaacaattaggaagccataaaggatatggttatggaatgttctgtgagattttctgttctattttatcacaaggactgacttcgaatcatacacatacaaatggcattgggggaacatgtcatggatttattgctattgatcctaaaatatttggaaacccagaagatattgagacacatttttcaacgttcctgcaagaattaagggatgctccaaaagctgaaggacaaccgcgtatatatactcatggtgaaaaagaagttgaggctacaaaagatcgcatggaaaatggaattgacgttgatgtcaagacagtattagagatgaaggatctatctaactttgttggtgttgattttgaaaaatactttggtaaattagatattgaagataatgattataaaacggtttattaattattaggagagaaagatgaaatttaagtgtatacattgtaatattaatattacagatatcaataaaagtgttgctttttaccaaaaggctttaggtttaaaagtcgaaagaactaaagaagctaatgatggtagttttattttaacttatcttggtgatggtttaagtaattttcaaattgagttaacttggttaagggatcatccgcaaacttatgaattaggtgaaaatgaaagtcatatttgttttgaagtagatgattttgatcaagcttatcagttacataaggaaatgggatgtatatgttttgaaaataaggcaatgggattatattttattaatgatcctgatgattattggattgaaattattcctaaaaaatagactgtatttttttgtatatttatttgcttaatcttgtttaaagagttattatagataggtaatatagaagatattatgggaaatgaaatattgagatgtttctgggaattagcaatttgggtgttaatactgaaatgatttgttctataattatccctatgtcataaatcaatatatactagtattagcgagctaataaaaaatatatccattaaggatatattttttgttattcaataatttttttaaaaagtcgatcaaaatctggtttgattttttttaaattaattggtcgtccactccgatcagtaaaacaatgattagagttgccagtagtacaaagtgtatgtttttgattatatatcttatattcacaggcgaagcggacaccagtatatttagttattttaacttcaattatagcaaggtcatcaaaatacatcattttttgataattacaattaattgataaaacaggagaaatgataccttcttcttccatttttttatatgttaaaccaatttggttcatataatcgattcttgcttcttcaaaccagcgaatatagttagagtgatgaataattcccatttgatcggtttcatagtatttagcattatgtaaataaggtctaatcatcattgttatcaccaataataaatatttccccttcattatttatctttaaaatattattatactgtttcaaaggttcgtgattgagatatttaagcatcattttaggattatcagtaaaatgcattggcaaaacatattttgttttaatattttttaaaatatgctccataccccaccagctactttcttcaagacgagggtctagaggaatcatcattaaatcaaaatgaatatctttaattttactaatttcttttttaaaagttccagcttgatatttgttgtcagcctcaggttcaccaatccagtgccaccagtgtaaatcaccagcatgataaatttgtttattttcaacctttacaacaaaagctacacctgcatctgttgataatagggtttgaatatacaaatcatcaatttcatatatttcgctagggcgaactttaattccagtattattgatttttcggtcaataatataagtgattttaggatggttgatttgataaattgcaggattgtagtggtcatgatgaaaatgagagacaaagacatataatggtttattttgattaagcgggggaattgttccttgataataatcgaatagtaaaatatgcttatccaattcaactaaaaacccactgttataaatataagttacttgcataaaatacctccttgtaaaaaaagggagaattattctccctcgtcgtaatttgcaacattatgataaatttgatcaacatcatcacaatcattaagattattcattaaacgttcaaataattccatatcttcaccttcaagttcaacagtgtcttgtggtaaagtctgaatttcatctatttcaaattcaatatcagatttaataccttcaattgcctctttgattttatataaatcagttggttcaccaataattttgatagttccatcttcttcactaacaatatcttgagcatcaacttcagccatgactaaagcatctaaaacagtttcttcatctagtcctttaaaagcaacgacgctgataacgtcatataaatatgaaacagatccttcatttcctaattttgcttttgactttgtaaaagcaggacgtactgatgaaatagtacgattaatattatcagttagacatttaacgattaaagtagctccaccattagcatacccttcaaatactttttcttcataattttcagtaacaccactttttactttatcaattgctcttttaataacatcagcgggtacttgttcttttttagctttttcaattaaacgacgtaatgctaagttaccatctggttcaggtccacctgcttttgcagctaagtaaatctctttaccataacgtgagtacaatttagctttttttgctgctgtttttgccattgcaactttgcgcacctcatgtgctctacccataaataactcctccttaaagtgataaattcttttaaattatacacttatcgattaatattatcaaggggcgttttaaatgagataaatattctgattttatgaggaaaaagcagagtttaatagataaaaagcagttgttttaaaataatcaaaaaggtttcatggaataaaatagtagttcatccttttctaattcaaaagaactctgctaaaaacattaagattagttttaaataaatagcgagtatgctataatctaggcattaaaaggagcaatgtatggaaacaacagtaattattggagctggagctagtggactgatttgtggtcatgaactagctaaaagtaatcataatgtaattattcttgaacaatcaaataaggcaggacgaaaaattttagctagtggtaatggtcgctgtaatttatctaatactaatttagatatgtatttttacaatactgatgaatccaagattaagaggattattcatgcctttgatgcaagaaaatattttaaccaaattggagtaatgactcgacaggtgggaacacttctttatccgcgttctaatcaaagtttaaccgtaaaaaatgctttaatgaataattttgatcaagttgctttaattgaagagtgtcaggctaaaaatattatcgttaaaaaggatgggtatatagttaaaactaataaaggtgaatacttttgtaataatattgttattgcaacaggctcacctgcttctttattatcaggcaaaaatagttatgatttggttaaattgcttgatttaaaggtgacaaagttgtatcctagtctagttcaaataaaaaccaaaccagcctaccgaagcttaaaaggcgttcgaactaaatgtaaagcgagtttattagtagatggaaaattaattgaaagtcaaaatggtgaagtgttatttagtgataatgggttatcaggaatatgtattatgcagttatcacgattattatcacgttattgcggaaataaagagattagtttagatctaatggaggaatatactagccaagaattagaacgatttttaaaagagcggcatgatagatttggtcattattatttagaaggaatcttcaatgataaattagctaaaatattaaaagatattgataatttaaaagatatccgctttaaaattatcgatacatatgattacagtaaagctcaagttatgagtggtggggttagtttggatgaaatagatgaaaatttggaagtgattaaataccctggaatatatttggctggggagcttttagatgttgatggtgattgtggcggatataatttacattttgcttttgcttcaggccatcatatcgctaaaacaataatgaataagcaggtaaaaaaatgttattaataaataatgtaaaagttcctttggaactggcagattatcgaaaaataatctcacaacaattaaatatttctaaaaataaaatatttgacgttaaactagttaaacaagctgttgatgcaagaagaaaaaacaaagttcactttgtttgtagttttaattttactgtcgagaatgaagatttaatgataaaaaaatatcctaaattaaacttatcaaaagtagttgcttatgactatccggttttaaaatcaactgacgagcatattgtagtagtaggcagtggtcccgctggacttttttgcgcttataatttggcgcgggctcatcaaaaggtaacattgattgaacgtggcaatgcggttgaacagaggaaagaagatatcgataacttttttaaaacagggaaattaagtcctgatagtaatgttcaatttggggaagggggagcaggaacttttagtgatggcaaattaacaactggggttaaggataaacgaaaaaaatttattcttgaaacctttgttaagcatggtgctgaaagtgatattttatatgtaaataagccacatgtagggactgattatttaattaaggttgttaaaagtatgcgtgagacgattattgctaatggtggtgaagtgttatttgagacaaaattagttgatgttaatttagcagatgatcagctagtaaacattgttgttgaaaaaaataatattaaaactacgatggaattagataaattagttctagcaattggtcatagtgctcgagacacttatgaaatgctatatcaaaaaggaataaaaatggagcaaaaatcatttgcggtaggacttcgaattgaacacttgcagtcattcataaatgagcatcaatatggtaaatatgcgaatcatccaagtttaaaagctgctgattataaattagcggtcaaaactagtaatggtcgtggagtatatactttttgtatgtgtccgggaggtaaagttataaactcaagtagtgaggctggtggaatcgttgttaatggaatgagtaatcaagctcgtgatgaagcaaatgctaatagtgcagttctggttactgtgggacctgaagattttgctagttcgcatccattagctggtattacctatcaacgagaattagaacaaaaagcttttgaattaggtggtaaagattatagtgtgccagtcatgagggttgaagattatttaaatgatactctggatttaaaaatggaagaagtaagctgcagtgttcaaccaaatgtgagatatgctaaattaagtcaaatatttagtaatgaggtcaatcttgctttaaaagaaggattacaattaatgaatcataaatttacagggtttacagaaaaagcaatgctttcaggagttgaatctagaagttcagcaccagtacgcttatatcgtgatgaaaattttcaaagtaatattaagggaatcatgccgattggtgaaggcgctgggtatgctggtggaattatgtctagtgcaatagatggtttaaaatgtagtgaatttattttaaaaggggaatagataaggaatgtcaataatagaaatagccctcattggagtgggcttagcaatggatgcttttgcagtttcaatctgtaaaggtttagcaatgcgaagaatgaactataaaaaagctattatcattgctgcttttttcggggtgtttcaagctttaatgccggcattaggttatgttttaggaacaacatttgccaataagattgcagctattgatcactggattgcttttatcttattagctttaatcggggcgaatatgattaaagaagcattatcaagtgatgatgatgaatgtcaagatgatagtttgagattaggggatttgatcatgttgtcaattgctaccagcatagatgccctagctgttggcattacttttgcgttctttaatgtgtcattattgctttcagtaagcatgattggaattattacctttattatttgtgtaattggggtcaaagttggtaatgtatttggtgaaaaatataagagtaaagcagaattagccggtggattaatattaattgtgatgggcgcaaaaatattaattgaccacttgttcttttaggaggataaaaaatgaaggtctcgactttaaagatgcatcatgagcaccatcctatgcgaccaacaagacagattgccattagctttttagcagttatcttaattggttcagttttgttaatgctgccaatttgtaataatacaacaccgacagcatatttaaataatttatttattgctacttcagcaacttgtgtaacaggattagtacctgtagtaacaagtgaacagttcaatatattaggacaaatcgttattattattttaattcaaattggtgggttaggttttttgacttttttaaatttattattaataatggtcaaaaagaaaatatctcttacaaataagttggttttacaagaagctttaaatcagccatcgttaaatgatctgcctaagtttgtaaaaaatgtaattaaatatacatttattgttgaagggttaggtgcaatcattctagcatttgtatttattcctgattttggaatcgtgaaaggaatttattattcaatctttcactcgatttcagcattttgtaatgctggatttgatgtgctaggagctaactcattgattggatatcaaaataatctaattatcaatttggttattccgggtttgattataatgggtggtcttggatttatcgtttggtttgatgttgctcattgtataaaaaaagagtatggaaaacggtcgaaatttagtaaaaaacatttatttaaaagtttttcattacatacaaaactggttattattgcaacagtagtattgttattagcaggagctgttttattttatttgtgtgaatttaataatatcaaaacaattggaggactacctctatttgatcaaatacagatttctttttttcaatcagcaactcttagaacggctgggtttgcttcagttgacatggcaagtttacatccttcaacgaagttgatgatgtgtgtattgatgtttattggtggttcacctgcaggtactgctggaggaatcaaaacagtaacgtttgcaataggtgtattagaagtatacaatatttatcatggacgcaaagaagtaacagctttttcaagaagaattcctaaacgtttaattgtgcgttcatttgcgattatttctatggcattagcaattgtatttttaagtatatttgctttgagtattaccgaacaggcaccatttattgatatttgttttgaggttgtttctgcaggagcaacggtaggattaagtgcttcactaacaccgtatttaagtgttttcggtaaaattgtaataattatgttgatgtatattggtcgaatcggaccaattacaatgatgatttcttttgcaagaaaatcatatatgcaagcaagtaaaaaagaggtaaggtatcctgatgggaatatcttattaggataaaaagagggtataaagatgaatagtaaacaatatgcagtattaggattaggaattttcggttcaacagtcgcaacaacattggcagaatatggctgtgaggttattgctgttgatcaagatgaatcatgtgttgagcgggtagctgatgaagtaacgaaagcagttgtagcgaatgttactgatcaagaagaactgcgagctatcggtattgaggatattgatgttgctattgttgcaatcggaacacatttggaagaagctgttttagcaactatgaatttaaaagaattgggtgttccatatgttattgccaaggctaaaaataaacaatttatgaaaattcttgaaaaagtaggggctaataaagttattcgtgctgaaaaagatatgggacttaaagtagctaagagtttattgagaaaaagtattgttgacttagttgaacttgatgaagattattcagtagttgaaattaaagcaccacttgattgggtaggaaagaattttattgatttaaatattcgtcgtgtttataatatgaatattattggaatcaaacatggtgatgaagatcatctttctctagatgttgctccagaatatgtgatccaaaatggggatcatttcttggtaattggtaagactaaagaactggaaagattcgattatatgactaaataaggacactttttaaactaaatcctatagaaaagacacaaaataaagaggagtgtcatctataggatttagtttatttagtccttttttattttgttataaatggttaacgaaggctaatataggctaagttatttaaatttatactaatgaatcatagttaatgaaaatgagaaatctattttaaaattaaatgatataaaaattgttaatcttataagaacttattaagtccttgtaaaaatgtttcaatttggtaaacttcttatgtatttgccgaattcctattgagaaatataggaaaatggactacaatttggttattatcaagggaggctattctttatgaatgttataattttgggtgctggtaaggttggaaaaactttaattaagcatatgtccaacgaggatcatgatattattgtgattgaccaggatgcacaaaaaatagaagatgtagtaaacttatatgatgtcattggagttgtaggtaatggtggttcttatgatatcttgatggaggcaggggcaactacagcaaatttgattatttgtgttactgcatcggatgaattaaatatcttagctggattaatggcaaaacaaatggggactcgccatacaattgctcgagtaagaaatcccgattattctaaacaacgtgattttatgcgtaatcagttaggtttttcaatgattattaatcctgaattagaagcagcaaatgagattagaagatcattatcatttccttcggctgtaaaggttgatacctttgctcgtggaaaagttgaattggcagaattttatgtagaagaagatagttatttacgtgatattccgctaagtcaattacatagtattactaagactaatattttagtatgtgctgtaagtcacaatgaagaagtaattataccagatggtaattatattattaaaccaggtgatcatttatttattacaggatcacatcgagacttatcaagattttgtttagatattggcattgttacaaataggataaaaaatgttttaattgttggtggaggaaagattgcttattatttagctaaacagttaggggttcaaggaataaaagtaaaaatcattgaaaaggatattgaacattgtcgtgtgcttgctaaaaaattaccgtttgttactgttattaatgcagatggaagtgatgaagaggtattattagaagaaggtttagagacaacagatgcttttttagcattgacagggttagatgaagaaaatttaattttatctttgtatgctaaaaatatttatcataaaaagactattgctaaagttactcggatgagttttacaggtcttgcggatagtctaaaggttgatagtatcgtagctccaaagaaaattattgctggtcaaataattcgttatgttcgagcaaaaatgaataaagatgatgattcaagtgttaaaactttatataagattgtagatggtgaagtggaagctagtgaatttatcgctacacctaaaataacttttttaggaatgacgttaaatgatttgaatttaaagaatcatgtgttagttgctgctatttcccgagaaaatgaaacaattgtacctaagggggatacgacgattgaattaggggatcatttagtcattatttctcgtggtgagacaatgaaaagtctaaatgatattataaggagataagcaggatgaataaaaaaatgattgtttttacaatcggtaagttattaacaattaccggtttattaatgttcatgccagtaattgtctcgttgatttatcaagaaacagagggggtttattatgcgatacttggcataataatgctggctttaggaattctaatttcaagaaaagctcctcgtaaaaagaatatttatgctcgtgagggttttgctatcgtagcattgagctggttattgatatcattattaggggccattccgttttgtttaactggtgagataccttcatatgtagatgcggtgtttgaaactgtatcgggttttacaacaaccggatcttcgattttatccaatgtggaggcattaagccatacaagtttattttggcgaagctttacacattgggttggaggaatggggattcttgtgtttgtaatcgcatttatcccgattgcttcaggacgttcattacatattttacgagctgaggttcctggaccggtggttggaaaattggtttctaaagtacgattaactgcacgaatcttatatgtgatttatgcaattatgacggttattgaaataattcttttactatttggcggaatgccgttatttgattgcattttgaatgcttttggaaccgctggtacaggagggtttggaattaaaaacgcaagtatcgctgcttatgatagtgcttatattgatggtgtgataactgtttttatgatcttatttggaattaattttaacttgatttatttcttcattttagggcgaatcaaggaagtattaaaaagcgaagaattgcgctggtatttgattataattgttgctgcaatagctttaattacgattaatattttaccattatatgattcaatcttatctgcattccgttattcaagtttccaggttgggtcaatcataacgacgacaggatttgtaactactgactatgggcaatggccagtattttcacaagtaatattattatcattgatgtttgttggtgcttgttcaggctcaactggtggtggaatcaaggtatcaagaattgtaatttattttaaaaatgcaagaaatgaactgcataaattattacatccccatagcgttcgtgcagttgaatttgaaaatcagccggttgaagataatgtaatcagaacgattcatgcatatttagtcgtatatattacgatatttgctctatcgttattgattttaacatttcttaatcttgattttaaaagtgctttttcagctattgcttcttgtttaaataatatcggtcctggtttagatgttgttggaccagtaagtaattttggttcgttgccagatgtttctaaaatagttttaactttcgacatgctggcaggacgtttagaacttttcccaatgctgcttttgttttcaccatcactttggcgaaagtagcataaataagaaaaaatcgtgtagaatatagagaggtgttccaatgaaaaaagaagaaatagtcataaaaaatgcattacgaatgactaaagaggccgatgatcagctttctatctatgccactaaaaatcgtgattgtataaaagtaaaacagacgattagaaatcgtgaagaatttgatatccgatggccgtttgaagaagacattgatcgaattttatattgtaaatcatatcagcgatatgttgataaaactcaagcattatctttttttaataatgctcatatttcaaagcgttctattcatgtccaatgggtgagtcggattgctcgtcagattggtcgtggtcttgctttaaatcaagatttgattgaagcggcggctttaggacatgatctaggccatgcaccatatggacatgttggagaaaaggctcttgataaaattctgcagataaagggatttggatattttgcccataatgctaatagtgtacggaatattctttttattgaacgcgatggaatcggttataatgtctctttacaagtgttagatgcgattctgtgtcataacggtgaaatgttatcgaaaaaatatatgccggattatgataaaactattgcgcaattttggcaggaatatgaagattgttggcaccaaaagaatactagcttaattattcgtccaatgacattagaaggctgtgttgttcgggtgtcagatgttatctcatatattggtaaagatattgaagacgcaattaaagtaggaatcattaaacagtctgatcttcctaaagaggtaactgatattttaggttttgataataaatcaatgataaatcgattgattggagatattgttatccatagttatggaaagccatatcttcgcttttctaatgaagtgtttagtgctttgaaaactttattgaattttttatccaatcgggttcatcaacatccggtgctagtaaaagaaaatacaaaattagtccgaatgattaatcagttatatcatgtttattatgatgaattaactgatcctaataatcatgattgtaaaataaaagcatttgttaataagatggctccggcatatagtaaaaatgatccagcattaatagttgctgactatttatcaatgatgacagattcttatgttttaaatgaatatgaatctatcttcttacctattcaacataatgaaatactttaattattatatttgtactatcttttgaaaaatcgtagtataatatatgtataagaagtataaggaggagttaatatgaaacttataatcgcaattgttaattcagatgacagctcatcggttcaaggagctcttactgaaggcggatacttcgtaactaaattatctactactgggggatttttgaaaaaaggaaatacaacattttttgttggaactaatgatgataaagtagaagactgtatttctattatcaaagcacattcaaagaaacgggtagaaaaagaacctactgttcctccaacagagatgggagaattctttacaccaattatggttgatgttttagttggtggggcaaccgtatttgttttaaatattgatcaatttgaaaaattctaaaaaaagaagtggcttagccacttcttttattctataatgttctaaggtggagaatatggaatatagaatattaaaagaaaatgaaataaaagaagcaattgaattagttgcacgagtagctaaaaaagatatttataaagactttgatcaagagggaattaatagttttaatcaagtaaattgtgatacattttatcgtaataaacaaaatttgacttatatatgtttagagaataaaaaaataattgggattattacacttactcagggaaaacatctaagtttattatttgttgataatgattatcagggaaatgggattggaacaaaattatttgagttgattgataatttggctttagctgatcttgaagttaattctggaattggggctaaaggattttatttaaacttaggttttaaaatggtcggtgatctaactaagaaaaatggtatattatattatccaatgcttaaacaaagggtagtcaataaacgttttaatacttatgatgaggtagttaattttataaatagtcaaaaagatcgggtatacagccttaataattttaaacattatatggaagatataggaaatcctcagttatttcttgactgtgttcatattggtgggacaaatggaaagggttcaactactaattatattaaagaagttttaaaacaggcgggatataggattgcaacatttacctcaccagcactatactcaagattagatattattcgtatcaatgaccagttcattgatgaagaaacaatggttagatatgcaaatcgatatgtggaactatggttaaaatatgaaatctcaatgtttgaaattgaagtatttattgcaattatgtattttattgagcagaatgtcgattttgcgttatttgaagtaggattaggcggtttattggatgcaacgaatatcattatgcctaaattagcaatcaatactaatattggtttagatcacgttgattatttaggtcatgattatcaaagtattgctttaaataaagctggaattgttaaagaaggaattgattacttaaccggggaaacaaaggaagaatgtttggctgtatttagagatgtttgtttaaaacatcatagtgagcttataactttaaaaccaataactaaaattattgatgggaataatgttagttatcattatcgtgattatgatattattcttgatacaccggctttatatcagattaataatagtgctttagcactagaagcactgatatatttaaaagaacatcaatttgttgattttagtgatgatgatttacttcagggaatgtataatgctcgctgggctggtagatttgaaataattaatattgaacctttgattattatagatggtgctcataataaagaaggaattgatgctttctatgaatgtgctaaaaaatatgacaatataaaaataatctttagtgctttacgggataaagattataaacatatgattgaaaaattgttacaattaactaaagatataactatttgtgaatttgaacatgttcgagctagtgatgctaagacattagcaaatggctttgatgttaaaattgagccaaattttaaaacagcgattgataaggcttttactcatgaggggacagtatttgtaacgggatcgttatatttcatctctaaggtaagggaatatataattgatagaagttagaatcaggtaatactgattctttttttgctaaaaaaatttcataatgagttttatttattatttttaattagatatgatataataatacaaagataggaggaatgacatgacgttatttttattattgattgcagtagtagtaattgtgtgtatttttgcaacaaggctttcatctaaatttggagtaccaactttattgatttttattttgttggggatggtatttggaagtgatggcttgtttaaaatcagctttgatgattttattataagtgagcaaatttgtacatttgcattaatttatattatgttttatggtggtttttgtttgaattttaatagtgctaaaccggtacttattagagcaacgataatgtcgacacttggcgttattttaacttgtggctttgttggtttattttgttattgggtattgcacactagtttaattgaagggatgctgattggagcagtaatggcttcaactgatgcggcttcagtatttagtattttaagaatgaagcgtttaaatctaaaagcaggtattgctccattgcttgaaatggaaagtggaagtaatgatcctacagcatatatgctgacaattattattttgacccttttatcaagcgggaaaactaatatttatatgcttatttttagtcagataatattcgggattattagtggtgtagtaattggtcttttagcaaaaaattatttagataagattcaattaaatgaagttggcttaaaatcgatttttgtagctgctctagcattgttagcatatgcattaccagtagcactgaatggaaatggttttttaagtgtttatctatttggaataatattaggaaatagtcgtttaaaaaagaaagtttcactagttcatttttttgacagtatttctcatatgatgcagatcttgttgtttttcttactaggtttattgtctttcccgtcacaaattcccgatataataggctctgctatcctaattacactatttttaacttttgttgcgcgtccgttaacggtatttatctgtttaacgccgtttagagtaccgtttaaacaacaattgtttatttcctggtgtggtttaagaggtgcggcttcgattgtttttgcaatcatgacagtggtatcacctgcatatacgaataatgacatttttcatattgtctttttcgttgctttactttcaataacatttcaagggagtctattgcctttagtagcaaaatggctcaaagtggaagatgatcaaaatgatacaatgaaaacatttaatgattatagtgatgatagctcatttgaattaattcgagtttatttgagtgatgatcatccatggataaatcaaacattaattgatattgtaatgccgactaatatgttagttgctacaattattcgcgataatcagatgatcttacctaaagggacaacaagggttttaaaaggtgatctattgattatgtgtgcaccaggttacgaaggaaatgatatttatttagatgaggaatacattgaagagcatcatcattggatcgattgtactctagcgatgatcaatcctcgtaataagtttttagtagtcttaattaaacgtgataataaaatgattatccctgatggtaaaacacggataaaacgtgatgatatgcttgtaatttgtaaaaaggagtacttaggctttgttgatgaataattaaatatgttgaagtgtctgctaatttgtagtattatttccattgtatacaatcttgtatataatttagaaaaagggggagtctactttttagtagcaatcgcatgtacggtcagtgatcggaattaacgcctgtggactagaaatgaggttgaagcaggaaagattgtaaataagtagcaatcaagttatgattcaaattatttgcggaattattttagttttaattggaatttttgtattttggaaatttccaattaagagtgatactaaatcactcacattagcagctttatttattgttttagccgctattttaaaaaggttatcgattatgatacctttgtttggttttgagagtctaaaaatctcaattgaagtaatcccaatgcttttagcagggataatgcttgcaccaggatattgttatataattggtcttgctgttgatttagttggattaattgtgacaccaacgggatttccttttttaggatttactttgagtgcggtattacaatgtttgattccatccattgtagttgccacgattaaagaaaattatatgaattatttagaaaaggcaatccaagtaattttaatttttttaggaataggggcttgcttttatgtatttagtttagatcaagtagttatttctaagaatgttgtagacattacacttaattttaaaataataattagtgtggtttgtattgtgatgataagtgtcttgtttactgttatgcgttattataaaaagaaattaaatgatcaggaatatcatttgtttaatctgtggttgatttcggtagtattagttgaaatggtaattacatttatgttaacgccttattggttacaagttatgtatggaattccatttacattatcgttatttatccgagtcattaaagaatgtatcatgattccagtagatatcattttaggatatagtgttttaagagtgttaaaacgcctataagagtcagttttgactcttttttgtttaattttttttaatatggaaaaaatattgtgaggtgaataatatgaatacatcacagtataatgaaattgctgaagatttaaaaccccaaaaacaagtggggaagcattgtttaagtgcatttatttatggtggcattatcggtgctgtcggtcaaggcattttagagttttacatgtatatttttgatgtgagtgaaaaagaagcaacaccaatgatgattattacgattgttttggctgctgctattttgacaggattgggaatatatgatcgaattggaaaaaaggcaggagctggaacttttatcccaattactggatttgctaatagtatgacttctagtgccttagaagctaaaagcgaaggtttagtaacaggtataggagctaatatgtttaaattaggaggaacagtcattacttttgggattgttgcttcgtttgtgttaggaggtattcgttatgtcatcagtcttatctggtagttcaatgcagttgaataatgtttatgttagagcaacaggaacaacgtgcgggattgacgaatttaatggaccgttaggtcaatattttgatagacactaccctgattttcattttggacataaatcttatgaattagcagaaatggcaatgcttcaagatgcgattagtcatgctttaaaaaaaggaaagttgaaaaaagatgacattaatgtctttttaggtggagatttaaataatcaagtcactgccagtaattacactgctaaagattttcaaagaccatttatggcgatgtatggtgcttgtgcaacaatggggctagttattaatacagcctcaatgttaattgaaaatcattgtattcataatgcaaattgttttgtttgcagccataatgcaaccgctgaaagacaatttcgttatccaattgaatatggtgtccaacgtaaagaaacaatgacaacgacagctacaggtgcagtcagtgtaattcttgataataatcctagcgctgttagaatagaagcattaactattggtcgtgttattgatatgaaccaaagtgatcctaatgacatgggaagagcaatggcaccagcagcctttgatacattagttaatcatctaaaagatttaaaccggcaaggaactgattatgatttgattcttactggtgatttatcaacttatgggaaatcgattatgaaggaattaatgaatgaaaatagtgttacctataatgagtatgatgattgcggctgtctattatatgatagtgatcaagatgttaatcaaggtgggagtgggccttcgtgcagtgctttagtagcatttgggtacatctatcagaaaatgttaaaacataagtacaagcgggttttagtgattacaacaggggcattattgtcaccggttatgactaatcaaaaacaaagtataccttgtattgcccatgcctttagtttggaggttgttgaataatgaattatctattagcatttattttttgtggctttgtctgtgtaattgcacagttgatttatgaatattcaaaattaactcctggacatattacgagtctatttgttgttattggtgcttttttagatttgtttcatatctatgataaactagttgaaatatttcatgcaggagcattattgccaatcacaagttttggtcattcgttgatgcatggagcgcttgcagcaactaaagaatttggcgtttttggattagcgatgggtatttttgatttaaccgcagcgggtattagtagtgctattttatttgcttttttagttgcaatttgtactaagccaaaatcatgatcaataacaatccatcatttgatttaaatacccgaacgcttgattttgaaaatgaaaaagttacaattaattatgtttctagtctttgctctgatgatctaattgcttatttagttgaagggattaccaaccatcgtggtgaaacattaaaagattgcttaaataatggtgatgttaaagacgaaccggattatcaaaaggccatgtattcaatgttaactggttgtgcaatgattagttatcgcgataaaacttatgttttagatactcgtcactttcctagtcgttctgtagaagaacccgagacagaaaaaagcgtcagaggctctaaagatggttttaatgaatcgatgctgacttgtgcgggtttgattcgccgacgaatacgtacgattgatctagttatgaataaacagacgattgggaaaaataatcccttagatgtttgtttatgttatttagatagcacagttgatcaaactatgctggaaacagtattacaacgtataaaagaaattaaaaatgaagatttggtcatgtctgatcgtgccgttgaagagatgatcttagatcaaggatataatccatttccacttgttcgatatagtgaacgcccggatgtagtagctacgcatatccttcatggtcatattgctattatttgcgatacatcgtcttcagtaatgatgttgccgaccacattatttgaaatattggagcatgttgaggagcatcgtcaaacaccaatcattgggacttttatacgattaattcgttgtagtgcagtattaatttctatttatttagtacctttatggctactattgacaagtaaggggactattgatctagtctttttaggacaagtcttgcttgttgaattagcgattgagttgttacggattgctacgattcatactcctacctctttgtcaaatgcgatggggatgattgccgctgtattattaggacagtttgcaattgatttaggaatttttagtgaagaaattttattattctgtgcaattggtgatgtcggtggttttgcaacccctaactatgagctatcgcttactaataaatatttaaaaatatttttaattatttttgttggttttttaggatggatcggttttgtcatttatcatgtgatcttaattggttatttagtatctttaaaaccatttggggtatcttatttatatcctctatatccttttgatggcaaagaaatgcttaattttattattcgtaagcccaagacgaaaagaggctcataatagactataacgtgatttaaacgctatagttttttgtttgttacggtcctaaaagaatacttctaaagcaataatatatatgttataataacaaatgcgtaatcgaagtgaaggaggtatcgatagtggaatatcaagtaataattgaagattttcaaggtccattagatttattactacatttgatcaaggaaaaagaaatggacttagaaaaattagaattgtctttgattgcagatcaatatttgcaatatattcatgctatggatccttctaaattagaaatcatgtcagagtatttagtgatggcggcagatttgattgaaatgaaaagtaagatgctgattcctaaagaaaaggtgacaattaatgatgaatatcaggaagaccctcgtgaagctttgatcaaacgactaatcgagtataagcgttataaagatgttttagatgaaattcgtgataaatatgaacagcgtcaaacagttattattaaaccggcagagtcaatggacgagtatgttgtggatactagttcaatgattcctgaaggattagaagtttatgatttaatgaaagcaatgcaaaaaatgtttcagcgaaaagcaatgatgaaaccactggatacacatattgctaaaaaagatatttcaattgatgaaagaacagctcaaatacgaaattattttaaaacaagagtaaataagaaagttaaatttgaggaattatttgaccgtcatgaccgtttctattttattgtaacttttatttcaatattagttttagctaaagataaagaagtagagattattcaagatgggttatttgaagaaatatatgtagaggggaaagtttaatggaacaaaataattatttagatattattgagggtatgttgtatctagctggtgatgatggtgttgatattaaacaagtagccggagtattagaaataagtaaaaaagaagcaacgctattaatggatcaatttacagaaatttatgggaataaagctttaaaggggattgttctagttaattttggcggacgttataaattagctactaatgctgattactttatttattatcaaaagatggtcgaacaaagcagtgctagtttatcgaatgctgctttagagacattagcaattattgcttataatcagcccattacacgggctggagttgaagatattcgtggagttggatgcgatgcaatgattcgtaagctcgtagctaaagccttgatcaaagaggttgggcgagaggatactccgggaatgcctattttgtatggtgtaactgatgagttcatggatacttttggtttaacaacacttgaagaattaccagatctagctgacattgttgaagtggatgaacaagaggatatatttgctacacgatatcgtgaagatactagtgacgatatttcaaaggcagaaagtgaattaaatgaaactgtttaagcattttaaaacaattacaaaacataaattttatgtaatgaaattatgtttcagatttggtttgtataaacaagggttaaaacatgatttatctaaatattcttggactgaattagtaacaggtgctaaatattatttgggctataaatcaccaaatagtaatgaacgtgatactattggttatagcagtgcctggctgcatcacaaaggacgtaataaacatcattgggaatattggatcgattttactagcaaaggaattatcgccattgaaatgccaattaattatgttgttgaaatgttttgcgaccgtgttgctgcaacgatggtttatcaaggaactcagtttaattttaaagcaccacttgattattataataagacgcatcactattatgtgattaatgaaaatacagatagaatcttgagagatatgcttgaacgcttggcgaattctaatttagatgaaacaattgaatatattaaagaaaaatatttaagaaatcattaaactgttcttatagaatagctacaaaataaaaaggaatatcgtctatgagagatatgaagtgaacccaaattattaggttcctttttattttaagtttatatatgaaaaatggtataaatttactataatagagatgaacgaaggtgattagatgaatgaaaaggggaaagctgctcatagtaactatgtacgaagtgtgtatttacaaattgtagctttagcattaattatgcatctaatctatttatgtattttctatttattaaactttaattttttagtagtttacaatctgtttagtgttattttttatggaatcatgctggtaataataaataaaggctattatcgaactgcagtattatcggtacatcttgaggttatcacatttgttggaattacagtttttacacttggatgggaaagtggttttcccttgtacttattagcaatggtatcgctagtatatttttggccatttaaaaattcaagatgggcttatttatgtgcaattattgaagtgtttatttatattattattagaataatcagttcaacccaagatgctccaatatatataatttctgataaaaatattattttaactctttcaatatttaatgcagtttgttgttttattgttatgatatacagtgtttttatttctgatgtttcttcaaaagcaatagataaattaaatgaaaatttacaagaaatagctgataatgatcagttaacaggacttagaacacgtcattatctatttgatagtttaaattcatctcctaatttagattgtaatattgtaataggcgacattgatgattataagattattaacgatacttatggtcatttatgtggtgattatgtattacatagtttagcaaatttgatgaaagataagatacctgatgatattgatatatgtcgttggggtggtgaagagtttgttttcttatgttttaatacaaataaagaagaacttacttatgtaattgaacgttttaataatctcttaaggcagcactctttcatttatgagggtaatgttattaagataacgatgacttttggaatttcagatacgatgaaagcaaagcatttaaatactatgataaagtgtgctgatgatcgtttatataaaggaaaacgttgtggaaaagatcagataattgtagatgataaaaagtaaagaagtgtgattagcgctagttatggcaaatcgcttgacttctttactttttatctttattaattattttattagtaaaatatgtaattaacataataataataaccatccagatggtccaggcaaaaatactgaccatatcaatttgtgctctagcaaaatacagctgtttaccaattccttgatttgaggaaacaaaaatttcagccatcacaccgacctttaaactttgtggtagagctgtttcaacggctgagacgatataccctttgattaaagggagataaacatgaattagattaaatttaaatggatggtgatagagaatcgtaacatcatttaaatcgttacttatgtttttaataccgttaacagcattattataaaatactggcaaaatcatcaataaaacaatgatgatcaatgcagtcagacttttaaaccataccaataaaattaaaatataggcaatttgagggatagtttgtaagaatgagaaaattggagctaagtattcattaacacttttaaacaagccactaaaaacgcctaagatggtcccaactattaaagctaaaaagaaacttaaagcaacacgtgataaagttgctccaattgcgatatagaaggattgactagttgctaggttgaacatttggttaaagactacaagtggtaaaggcaagattactgctttatcaattgataaagcaaaaccttgccataaaccaataattaatattaaagtaattattttacgtctcatgaacttaacatatttttattataatcaatgttaaataattttaagaagtctttaatttgttcagaacattcactagcttttttataatggacattttgacgatcgatagatttaactgtaatttcaacacttggcaaactcaatgtctcgataccaattttttctagatagtcttttaatccattgtaatcattattagtgaactgatcgattgcttcaaatagttcatcatagttgttattttctttaacaaagatagcggcttgaggataaccatctttaccgtattctttttgtaaatcagcaataattgaaagttcaattcctgcttgtttagctttagcaatcgttgcacttgcaagtggttcagctaacattccaacttgaatgttgcccgataataattgttgttgtactaatgttgctgattgatagtacttaggagtcaatgaagtattaatttttacagtatcaacgattttttgaggaactgcaccttcaccgaataaacccagttcgccagtctgatttaatgcttcgttactagttccaatatagtataaattaccccaggtaataaccccttgaatacgataatcggtttgttcgctagcaatcaatttagcacctaaattaattggggcaacaataatatcgtaatcactgctattttttgataattcagcaacaagctgatcgctaccatcaacaaaatctatttttccttttttactgatattttcatactcactgacaaaggcaagtgacggagctcccgcaggacatagtattttaactgtattggatttatctttagtttctgtatttgaacacccaatcatcgtgaatatcatcattaaacataataaatatttaattattttcttcatatattcccccctaacgataattatttaaaccgttcttttcttgtataatgtgtgtgtaataaatgatgtgctttttcgctgtttggttcacctaagaaatcagcatataatttttgaatttgtgaattcttatgggattttctaacaggtaatgctaagtcttcatcatacaacgctttagcacgagcttgtttccagtcaaaaccgctattacgagttaaagcattaacatatgattgaccaccaccgttaacacatccgccaggacatcccatgatttcaatgaaatgatatttagatgtaccgtttttaatttcttcgagtaaaggtttagctagaaccatactatgggcaactgcaacatttactgtcatatcaccaatttttaaactagcttctttgactccttcttcaccacgaactgcatgatagtctaaattagttaagtcttcttttgttaaaacatcagttacagttcttaaggcagcttccattacaccaccactggcaccaaagataactccggcacctgtgtattcaccgaacatgtcttgatcaaaatcttcgtctttcaaatcacggaaattaatcccaaacattttaattaatttacctaactctctagttgttaataccgcatcaacatcttttaaaccatcagttaagttttcttcacgttctttttcaccttttttagcaacacaaggcataatagaaacaacatagatatcttttggatcaaggttattttcttttgcataataagatttaatcattgaacctagcatcatatgtggtgatttacaacttgataaatgatctaataattcaggatattcgtgttcaatatagtttacccatccaggactacaagatgtaatcattggtaaaactccatcattgctgatacgatggataaactcgtatccttcttccattatggtcaaatctgcaccaaaatttgtgtcatatactctatcaaagcccattaattttaaggcatggaccattttaccagttactctagttcctattggcattccaaattcttcgcctaaactggctctaactgctggtgcagtttgcactacaacatgtttactgtcgtcatttaaagccgcaataacattatggacttcttctttttcttgtaacgctccaactggacaaacattgatacattgtccacattgcatacagttgacatcattcatactcttatcataaactggaccaactttagttttgaaaccacgattcataaagcctaggattcctaaaccttgggttttagcacatgtttcaacgcagcggccgcaaaggacacactttgaagtattacgaacgattccaggcgaaacttcatcaaaggtaggagctgttttttcgccagcaaaagcatcttcgcggactcctaattcttgacaaagtcgttgtaattcgcagtttgtattacggatacaagatagacaatctttagagtggttagaaacaattaattctacgactcggcgtcttgcatctaaagctcgttgagaattagttttaactactagtccttctctaacaggataaacacaggcagcgcataatgtttttgcaccttcgatttcaacttggcaaacacggcaagcacctgttcctgtaacatcttttaaataacataaagtagggatatggattccgttatttttggctgcttccaagactgtttggccttcatatgcctctacctcacggttgttgatagtcatttttattttcgacattccttacacctactttctttcaattacattaaagtggcatgctttaatacattgaccacatttaatacatttttcttgatcgataacatatggaacttttccaagttcaccactgattgctccaactggacattgtttagcacaaagaccacacttacgacatttatcttcatcgatttcatattgtaataattctttacataccccagcaggacattttttatcaacgatatgtgcaatatattcatctctaaattgatggatcgtagaaagtacagggttaggagcagtttgacctaagccgcatagagcagtatcttgaattgttgaagctagtaattcaagttcatctaaagtttccattgttcctttaccgtcacaaatttgttcaagcaattctagcattcgtttggttcctacacggcaaggagtgcatttaccacatgattcatcaacaataaaatccatatagaagcgggctacatcgaccatacagttgtcttcgtcgagaacgatcattccacctgatcccatcattgagccaagttttactaattcatcaaaaccaattggtgtatctagttgttcttcagtcaaacagccacctgatggaccacctgtttgaactgctttaaagcgtttgtgatttgggcagccaccaccaatttcataaattacttcacgtaaagtagttcccattggaacttcaactaatccagtattaacaatttttcctccaagggcaaatacttttgtaccaggtgatgtttcagtaccaatgctcctaaaccattcagcaccatgttgaataatttgagcaatattggcatatgtttcaacgttgttaataatagttggttttccccagacccctttatgggcaggaaatggtggtttcggattaggcattccccgttcaccttcaattgattgaatcaaagctgtttcttcaccacaaacgaaggctccagctcctaaacgtagttctaaatcaaaatcaaaaccactctcaaaaatatttttaccgattagtcctagctcacgtgcttgctctaaagctgtatttaaacgttctacggcaataggatattcagctcgaatataaatatatccatggttagcaccaattgcataagcggcaatagccattgcttcaataacactgtggggatttccctcaagaattgaacgatccataaatgctccaggatcaccttcatcagcgttacaaataacatatttttctttaccaggttcatttaaagcaaattgccatttaactccagcagggaatccaccacctccacggccgcgtaatccactagctttaattacatctacgacttcttgtggagtcatttcgctaactactttagctaaggcaaagtagccatctttcccgatatattcattaatgttttctgggtcaattacaccacaattatgaagggcgattcttttttgtttattatagaatttagtatcatttatatcatgaatctcttttgtttcttcatcagattcatttaacattaaacgatgaactggacgacctttatagaagtgttccataacgatttctttaacatcagaaacctgaacagttttataaatgatattatctggatagatagaaatatttggaccaactccacataatcctaaacaaccagttcttaaaacttcaacttctttttcaagcccaagagctttgatttctttttcgaattccgtgattagctcacctgaattaccgattgtacaaccagttccagcacaaactaacacttgggttctttttgttggcatcttacaacctcctatttcttataatgtccgacagtatactcgtcgattatttcatcatgttttaagtgtttttcagcaatttctttagctttagcagagtctactaatacatatgttgttttattgtcatcgcgatcaaacacttctacgattggttctagagtgcacattccaatacatccagtttgtaatactgttgcaggtaatttttcttgggcaacagtttctactaaagtgtttaaaacaggacgcgctcctgctgcaatcccgcaagttgccattcctacgacaacccgatatttttgttgttcatctgtccgcattgacatgttgctttgagcagcatcacgaagtttttttaaatcttctaaggatttcatagttgcaatccctcctttatatattcttttaaccagacaattatctctggttgattaattggaacaccctcaagaatttttttaatttcttgagtgtctaaaataaattctaatttatcacttgtatatttaaataaataattaattttttcatcagcttgaattaaagtaataattgtttcaacaatatttcccattggtggcgtatccaaatgatttttaataaattcaccagttacatgagtaccttttccaacttcggattcgattttaaaggttcctccagtagcttcaatgttttccttaaacattgggactccaagaccgacttttctagtggttcttgttgtatagaatggatcaataacattttttacagttgttttgtccatcccaatgccattatcaataatttggatattaataatatttaatttactgctatcgtgaataatgatcttgatcaaattagcctgagcttttattgagttataagcaatatcgagaatattcattgcgatttcctgcattatattttcctccacagttgataaaaatcatctttattaatttgattgactggttcattgatagcttctaaattatgagcatcgctgttataaaagacatgttcacaacgcacagaagggcatcttttttttagttcttttaattcccttaaattaccaacttcaataccatcataagctaaatcatcgggaattccttgatatatctcatagattccaaattttttagctaatacatgagctaaaacagctattccattaaaagaatggattgtctcaatgatttgatatatatctagatcaagggaactgatcaataaattgtcttcatgatcgataatttcatcattgacattaaagatatattgattgccataataatcgggattatttggaacttttattaaataactgtcgatccatgcttgaatcgattttaaatcggtgtcttttaaaaagtaggcgagaatatgaatctcttctttactctgtaattcaacaccatggatataatcaatcttgccttttaagatttcatgattgatgatttcttctaagtagttttgttgttttaaagaattatgatcagtaattgcaattaattccagacctttaatataagacatattaaaaatgttattgattgtcatagtatcatcgccacaaggagagagagctgaatgaatatgcagatcgtaatacattttaaagacctaaagaaattaattgtttacaaagatgataagcatcaagctgactaataaataacggaatttctaattcgtcagctttagcgatggtatctccatccggaaaactattttggacaaagataattccagcaaaatcatttaattcagctactgctacaacatttaaatgtttttggacagtcaaccataaagcaccttccttaccatttgccataacaaaacttaacaaatctccaatatatacattctcaacaatattagtcaaaggtgctttgtttatttgtttgatttctagttgaagtatttctttgatattcataccatcaccttctttttactcgacataatgaatcatcaacctcaccactagcaattcgtgaagctagaccgcgacaatttgcgaatccacagctgccacaatcatattgaggtaaagtttctaaaatagcatttactttattaaaccaagctaagcgttctttgaaattcttttcattaccacttgttatttcatgtgctttgatataatcttttttatctaacgaagctaaattaccattacaatcatcgatcatgctttcaatattaaagcagccttcaaaaggattagaccataaataatagccgccgatacatccttggaaacaagcaaataatgccattaaatctacatgttttagttgatcaaattcaattaaatccaaggcttttctaatttgtgataatccttcaacactgattgctgaaagtcttttatctccataaagatcaccaacaatactttttactccatattcattgatttcaagttcttcttgtgaatcatttttaaattgatttatccgtggaaacatttgtgaaacacttaaggcataatcgatatttgaatcttcattaccaaaaggttgtttagcaagtgttaattttccaacacactcacataaagaatagatagcaatatctttctgtgcgtatttttgccgtaattttttagcagcaatctcaacaggataatcatatggtagtaaatgatcgatcaaagtagggtaatcattaataatcagtttattaattgtcgggcaaaatgatgttaacattacttcttcaccatttttactatcttttaaaccctgtttatataaaagtccttcaatatcactatattgaactacttcatcaaatccaaactccttgattgcatgagcaatattttttatctcatcatatgtttttaaatcagataagattgcagtaggaatcaatgcaatattgtaatcatgtttttttaaggtgctttcaagatcgatatttttaattcttaatactttctggtcacatgcctgaatacaaatgtcgcaattaatacacttatcttcatcgataattacttgttcattgacaattgaaatggcatccataggacatgatttaacacatttaatgcagtttttacaaccactgcctaaataactaataacttgcttcattaaaatgtcatcttgatgtgggttccctcatttgaagaagtaatttcaaaggtagaagccacacttttcatgttgtaaagacccattccggcaccaaaacctaattcccgtgctttgggtgaggccgttgaataaccgggtgtttgagcaaggtttaaatcttcaatcccaggaccaatgtcatcaaaagctaaatgaacaataccgtcatcatcaatttcaaaagtaactgttcctccatcggaatgaattgcaatattgatctcagcttcatagcaagcaatcgctactgcttttagaatttttcggtcaattcctagggcttttagagtccttttgatatcacttgatgctttcccggcatcttgataattatctttttctacttgataagttttaatcatcgtcgcattcctgcctcgtatagcttgccgcaagcttcaaacattgtttcatcagtttggaagagattaatatgaagatttttagccatatcaacaattgtcatgtctagtggctttcctctaacaaataaaattgtatcaatatctaaaacttctgctgtccttaaagattgtacgttggctagaccagtaataaataatacttcttcggtttcgtttttcaataatgctagagcatctgacattaaatcagaagagaagccctttttatagtctttttgatagattgcttgatcatcaatatatatttccttcgcttttagtatatcgacaatctctttaactaacatggggcttcttctttcaaataatctaagacaagcatttttaaatcttctaattgtttagtacatccaaaaacaattccgtcaacactgacaactggcgcaagaccacaggcaccaacgcagcgtgttgcatcaattgaaaatagtccatcaggactagtagaatttacttcgcatcccgtcatttcacaaagtaagtctagaatagtttgggaaccattaacataacaagctgttcctaaacatacggcgataacatgtttacctttaggttcagttgtaaattgagaatagaaagtgactacaccgtatactttagatactggaacaccaattgtttcagaaattttttccattgcttcaaaaggaatatagcctaattcgttttgaatctcgtgaagcataagtttcattggacctttttcatctttgtgcttagcaacgatttcgtcaattttatccaaatattcttgtttcaactttttcatttttacacctctttcttttttatcatttgatttaattataacataagttgaaagcgctttaaatacaattaagtcaaaagtaccatatatttgtaagttatagcgatagataaaaaaatatatatttgataaatatgttagaatataaacacaatttatcttttctatgttaaaataatcactaaggagatattgggatgaatctattacatttaaaatacgtgattgaagttgcaaaagccggctcaattagtaaagctgccagcaatttatatatgaatcagccgcatttaagtaaaacaattaaagatctggaagaaaatatgcagataattatttttgaacgaacttcaaaaggagttattccaacaaaaaaaggtgctgaatttattgaacgagctaaaagtatcattatgcaggtagaagagatggaagccatgtatcaaggatatgatgataagtctgttcatttagatatatgtgtaccgcgggctagttatgtcgctaatgcgtttactaattatttatcgatgattaattttcatgataaaaatattaaggttaattatcgcgaaacgaattcttttgatacaatcaaggatgtttatgaaggagaagcaaatattggaataattcgctttcctattgatgaagagagttattttctccatttactagaaacaaaggaactaaattttgaaaaactatatcaatttaattatcaattattattttcaaatgaaaatccgctatcatttaaagagattatttatctatctgatctagaaacccaaatagaaattacacatggggatacagctttaccatcattaccgatcgtagcaaccaatcgtaatgatgaaacacgtcatagtaaaaaagaaatttcggtatatgaacgggctagtcaatttgagttattaaatcatctacctcatacttttatgtgggtgtcaccgattcctcaagaagttttaagacgttttaatttagttactaaggagtgtcaagaaaataaaatgagttatcaagatctgttgattacgagaaaaggatatcgtttgtcgaaagaagatgagggctttattagagcaatcaagtgtagtattaaagaaattaatatctaggtatacataaaaagggatagggctattccttttttgtctcttcataactaaatatgtaagcgctataatttggttatggaggtggtctgatgcaaagatttacattacctagagatttgtatcacggaaaaggttcgttagaagctttaaaatctttagaaggaaaaaaagcgattatttgtgtcggtggcggaagtatgaaaagaaatggttttcttgatcgtgctatcgcttatttagaagaagctggaatgcaagtaaaactatttgaagggattgaacctgatccatctgtggaaacagtgatgaaaggtgctgcagtcatggaagagttccaacctgattggatcgtagctatgggtggtggttcaccaatcgatgctgctaaagcaatgtggattaagtatgaatatccggaaattacatttgaagaaatgtgtaaagtttttggtattcctaaactaagaaaaaaagcacatttttgtgcaattccatcaactagtggaactgctacagaagtaacagcattctcaatcattacagattatgaaaaaggaattaaatatccaattgctgattttgaaattacaccagatgtagcaattgttgatcctgatttagctgaaacaatgccaattaagctagttgcgcataccggtatggatgcgatgacgcatgcgattgaggcatatgtttcaactgcgaattgtaattacactgatccattagcgattcatgccattgaaatgattcaagctaatttagttaaatcatacaatggagatatgggtgctcgtgacgatatgcatgatgcccaatgtttagcaggacaagcattctctaatgcgctattaggaatcgtgcattcaatggcacataaaactggtgcagcttttgttgatcaaggtggtcacattattcatggggcagcaaatgcaatgtacttgccaaaagttattgcctttaatgcaaaagatgaaacagctaaaaaacgttatggtgtaattgctgattatatgcatttaggtggaaatagtgatgatgaaaaagtagctttattaattgcatacttacgcaaaatgaatgatgaattaaatattccacattcaatcaatcattatggagctgatggattaccagcagatactggttttgttagcgaagatgtattcttggcacgagttgataatattgcagcactagcaattgaagatgcttgtacaggttctaatccaagaattccaactcaagaagaaatggttgagttgttaaaagcttgctattatgacagcgaagtagatttttaaaaaataaaaactttttagcgatttagacaaggaagcaagggccttgtcttttcttttgttttatcaaaagaatatactataattagttgaataaagagacttatttgtagtagaataaccgttagttaagaaaaaatcattgtgagtacagtgataaaagtaaagcaggtgaatgaaatgagtctttatgtaacgagacacggacagacaaattataatgttaatgatttagtttgcggaattagtccagccgctttgacaacagatggaattgaacaagccaaagaattgggtcgacaattaaaatcaattaaatatgattttttatatgtatcaccgttacaacgtgctattgatactgctgactatgctaatgtagaaggtttagaagtgattattgaaccgagaatcagtgaaattaattttggtatctatgagggggtacatcgtgatgatcctggttttattgctaataaacataatttagcaatacggtatcctaatggtgaatcgtttattgaattatgcaagcgggtctatgaatttcttgatgaaatcaaagaacaggcaaccaaaagtaatgttttattagtgtgtcatggtgctgtttgtcgggcaattaatacgtattttaatgagatgagcaacgatgatattttttattatcaaacggaaaattgccaattgcttaaatatgattatttatctagataattgcttaactcatcatggtcaacaataatgattttacgataggctaggtcgatccagcccttttgataaaaatcattgagaattttagtaacagtaacgcgattaagtcctgttaaagaggctatttcttcatgtgtgtatgagatagtctttttcttttgttctaataaaaaagcagcaattttttcatggcggttataaaaatatgctttttttacttggttagtaagatgatcattagttgaagataagagctgcatgattgctatagttagttcttttgattctaaaatggcaggatacaaattttcaagattacaagagatcaatttaacttcatcaatagcactaacacaaactggtcttgaagtgtttaataaaaatgaagattcgccaaagattcttcctttatcgatgatatctaaagtgatttcttgtccgtcttttgaaattaaataaacacgaacacgtccttttaaaatcaaataaagattgttgcttgaatcttcttgcatatagataatatcgttgggctgatatttgatcaatgtacctgtatttttaaagtaattaaagagattttctgctattttcatattttttccaccttttttcttaattgtagcatatgttacattctttggtaaataattatgctatcttataccccgaggtgataatatgaaaggaaaattattaagaatcggaactattatattaggaaatgtttttgtagcttttgcggtaagtactctggttttagaaaatcaattaatttctggaggagtaactggtctaggaatcgttactaatcattatactgggataaatatttcacttatcgtaggaatcattaatgttttattatttttattaggattattctttattggtaaaaaatttgctttatctacacttatatcaacatttgcttttcctgttttgctagaatttttcaataccaatgcaattttccataattattgtcaagatactttattagcagtcgttttagcaggctgcttagttggaattggggtaggattaatgatccgttcagatgcatcatctggaggtatggatattattgcgattatcttgaatagaaaattaggaattccagtattcattatggttaacgtatttgattttattatcttatgtatgcaagcaaccttcagtaatccaactaaaatcttatacagtattgttcttgtttttgtaacatcatttatgttgaataaaactttaacaaaaggttctaagatggttcaattagtagtaattagcgattgccatgaaatgatcaaaaaaatgattattgaagaagcggatgctggggtaacttctttatatagtcaaaaaggttttaatgagactgacactaaaaccttattaacaattattccaccggttaaattaaccaaaatcaaagaacagattaaattaattgatcctgttgcatttatggtagtagcaacggttgatgaagttagtggccgaggatatacattagaacggcatcattagtgatatttctttgagaatatggtaaatattgccatttcctgcaaaacgattaagatctttaaaatcatcagttagcttgatccaggctaactgattttcttcaccgtgaatatcaacattggttgaaagggtaccaatatatgtttctagaagagtatcatcaaggtaataggtaaaatccataaaatggatcagttcaatatctgttttagatatattagtttcctcggctaattcacgatatgctgcctgaagatgatcttcatttggctcgatttttcctccgacaaaattataaattcctttaaaaggagctttttttcttttacacattaatacttttgatttattttgattaaatacgacaattatgtttacatttcttttcatttcatttttcctctgcgtatattctatcatattaataaaatcttaagaatatatttaatgtaatttagttaagatagtgctataatgcactagtataattggtggaggagagtatggaaattattgaattaattaaagttattattttaggaattgttgaaggtattactgaatggctaccaattagtagtactggacatatgattctagttgatgaatttattaaattaaatgttagtgctgattttttagaaatgtttctagttgtaattcagctaggagcaattttggcagtagttgtactttattggaaaaagttgataccttttgattataaaaatagatggagaataaagaaggatactttttcaatgtggtttaaaattatttttgcatgccttccagcagctgtagtaggtcttttgtttgatgatcaattaaatgagttgttttacaatcctttgacagttgcaattgcattgattgtttttggggttctgtttattttcattgaaaattacaacaaaggtaaagaaacaaaaatcaattcattaagtgaaattacttataatacagccttgatcattggaatctttcaattgattgctgcggtatttcctggtacatcacgctcaggagcaacgatcgttggggctttattgattggagttagtcgaactgttgcagcagaattcactttctttttagcaattccagtaatgtttggagccagtttattgaaattagttaaatttggttttgcttttacaacagcagaattgttattattagtgattggaatgctagtagcttttgtggtcagtatgttaacgatcaaatttttaatgagctatattaaaaaacatgatttcaaagcatttggctggtatcgaatcattttaggaattattgttttaatatattttatggtattttaaaagctgaaggattgtagctatgttacaacttttcagtttttttataggtgaaaatttattatcaagcaaagtaaaagagtataagtttactattttaacttatactttttgaattctatatttttctattattttaatgtatattatttcttctttttccaaccatgtctattactgtcatttttaatacagttgtaaccctcatcatatcggtattaaatttaaaatcttcggcatgatattgtcgcattagaatctttaatgattcatatttattctcgtcgggaacagtttcaataacaccatgaccaataacactttcatatcccattgtgcagctcattctttcttcataaagaataaaattgtgatcacaatccatttcaaatgttacacggttatctttcgcaatcaagtctaatttttttccttccatggcacaatgaaaatataaatatacttcttttccctggatatccaatccaaagttgagtggaacaatatagggaaaatctttatcatttaaggcaattctacaaacatcacattttttaataatgttaatgatttcattaaaatctgtaatctctctatcttttcttctcataatattctccttatcaaaatcatatttgtctgtttaattttatgttatagtatgatatttattgaatgggtcttttttctagatttgaaaatatatttattattttgaataaaataaaaaccgctctagaaagcggtttatagacttcatggcatcctcagtaggaaagttttagatagaccttttaataccttttagtaactcaaaaaccgcaatctagagccatttttaattttttatttttttgttttttgtgcagtattactgcatatttactgcacggttagaacttatcaagtacatccaaaatctcttttcttttatcaggaaacatgtgtgaatatacacgttcaaccatatctttgctatgacctaaacgttcagcgatagtgaagctcgtcacgccattattgatcaacaaactcacatggctatgtctaaaatcatgtattcttatttctggtattttatcatggctgatttcattatacttcttaatgtatttatttttacgattggtgattgttcttattggtatgggtacaaatacacccattatatagcaatcgttgttaaaaccatctatatcgctatttatggcataccactcttttaattcgttaatgagtatcttgttcaaatatattgttctgttttcaccggttttcgttgtgttgtttacaattttattcttattgtcgaatgtattatgtatttttaaagtgcagctttcaaaatttacatcattccatgtgcgtgcctgcatctcaccgcatcgcattccagtccagtataataaatcaaaaagtataatgtcttcttttttttctaaaattgatttaaacttgcagtactgttcatatgtccaaaacagcatttcttttttcttctcgtcaggatttttgacctgctcaactacatctaagggatttattaatatcatgcctctgcgtactgcaaatcgcattatagcgctcatagttgtttgaattttttcaaggtaattattaacatagccttttgttaatagtttgctttgccattcttcaataactggtacagttattctagtaacatacatttttccaaaataaggtaatagttgtttattaataaggtttgtatagtttgaaatcgttctaggtttcacacgttcctttttataatctaaaaattttataattagatcactaaatctgtacttagtatttgggttagttcttgcctttattaaatattctctttcagctttttttgcagcagttggactagaaaatcctctaacgaaatatttttcattttcaccaaacacattaataaaagtacctgaaaaataataggtacctctttttttatctaaatatactggcatttttattcacccctttgatataataggagcatagttaaaaacactagatagttgaaatagttctgttttaactatactttaattttgccgtgttattgcacggctttttttatttttttattttttgtctatttttttagaaagatcattaagactcatttcgtaaagatcgcataattttttgatatcttcaaaataaattctgttacgaccgctttcgatatctcctagccaactttttgatttacttaatttttttgtaacctcttcaagagtaaaatttttattttttcttgcctctttaagtagttgaccagtttttttgttaatattgtcttgcatattgtccacctcgataaaaattataccacataataatacgttgtaaacgtaaaaaaataacatttttttcattattccgttgacagtggaaaaaatagatgctaacataatgcgtgtagtccgttggcaacggaatggaaaggggagaataaatgaaaaaatttagtgtaaaagccataagagtaaatttaggactaacacaagaggaaatggcaaaggaactgagcatttctgtacgtgcatatacggataaagaaaatggtaaatcaaaatggtactgggatgagattttaaaaatttgcgaaatagcagaattaagtccagaacagataaaataatttttttacttattttttccgttataaacgtacaaagagaataggtcttaatagtatattagggaatatattcatagataaaataaggaggattttatgaatcaattgcaaattattgaacatgaaggaattagagttttaacaactcatcaactagcagaagtttatgaaaccaatgcgaacaatattaagtttaattttaataacaacaaagaaagatttacagaaggtaaagattattttttattaaaaggcaatgatcttaaagagtttaagaactacgttagtgatactaacctagtcaatccaagaacaccgcatctatatctatggaccgaacgtggagcaaatcgtcatagtaagattttggatactgatcaagcgtggaagcagtttgatgtattagaagaaacatatttcaaagtaaaaagcatgtcagcaatgcagttgttgaaattacaaaatcaggcattagttgaagttgatgaaaaagttgaacacatcgacagtcgcgtaactaatctagaaaacacaactactgtagacagtagaaagcagtacacactaagaaaaattgcaagtgcgacagcagttagagttttaggcggtaaagacagccaagcatatttagaacttcatcacaaggtgttttgtcagttatggagggactataaagattatttcaaaatcccaagttatcgcgacaccctaaagatagacttcgaaaaggcaaaagaatatttaagcggttggcgtcctgatcataatctacaaattgaaatttcaagtgtgaacgaggtgaactagatgtctagaaaaggattttttgattatgaaaatgcagatataaaaccaattgagccaaaaggaaatatgaattctagtacatggaacttagaaaaaaacaatgataaagctattaatccggaaaatggggatgcggtgttgatatgcaagggaatacagttgtatccgcaaaaattagcaaaattagaaaaatcaataaatgaattgaataatcaaatgattgaagtattggatgaagaaacatataagcaattaaaaaagaatttaaaaatactacaatcaaattttgaaaaattaaatgagagtagtattcttatgtatcttttttaaagttttatttttaaaggattacctttagcatctgtcaatgttacgggctttgctctagtaaagtcaatatcatttattacctgggtaagttttattttgaaatcttcaactaaatttaaatctgacaatgagtagtcataaactggataagttgaaatatcaaaaggtattctatcattagtttgttgtcttattaagataaaaggggagttatgcttatgttcattcaaagccaacctatatcctaattctaaaaatacattagcattatagcctgttatatcaacaattgctaattcgtcattatacaagtggttatagatattttgatctaatttatcagttgaagttatttcatcagctcgaattagtttaatatcaaatttatttagaacaggttttattaaatgatttaatactatgtctgagtgttttcgaatttcgctgtctacattgcctataggtgatacaaaaaaacatgttttattcatatatattattcacctcactttcatttaaatttcgacattgcagtgtcgataaataaattatagcaaaggtgaaaaataaatcaaaaaagaaaggagtatcgatatggcacataagaaaacattaaaaaccatcaatattgagcgtgaaaaggttttgatgaagggttatgcaaatattgcagatataaaaaaatttattccatgtagcgacaaaagagctaatgaaataaatgaagaaattacttgcatggtagaaaaaagcggtaaacgtgttttcttgggaattcgttctaaatatctgttagattacgtaggtctaactgcaaagcaggtttttgattttgctgaattagaacgaaaaaaagctgctatgtccagtagcagctaatcaatgaaaccacgttaattatagactataaaaaggagtgtgtcaaaggtgaataaagaaattattgaacgtttaaatgaaataaaacgcgttgttaattctaacactttagaggagcttatcgaagcgtatccggatgctgcgggattttctctttgtaaagaatctacatatccttcaattgtaggtataagctcatttcttgtcaataatctgataaaggatattgaaaatggaaaagtacattaacaggcttaatgccagaggcttttatacaatcgttttaattattattttggtaggttttatagctgcgggagcttctggtatcattctcgattttatcgtcgggataataaaaaatatataggtttttaacagtgtttttagggtactgtttttatttgcaccatttttaggaaaaaggagggattttatggataaaatcaaagcggaaatggattcttctcaaaatccatggataaaaaaaataggtaattatcttttatcaagaaatgatttagaggataaattgaataatcaaaataagagtttaaaagagtgttttgattacattctaattgagatatcaaagcagagcgtaaaagagggcgttactggttatgctgccggtgatgatgatgaaatatactcacttgctgttcactattttgatgaagataatcttgaaattggaaagaaggattttactaccaatgcagacggcagtgcggaactgtcaagattaatgccaaagaaacaagatgttaaggagcatgtaaaagatattgatgcaattgtcaatcaaaaggtaaaggctgaacttgaaaaaatccgggaggaagaaaaagtaaaaaaacagaagatagaagagttaaaaaaagcagctaaaaaacataaagaggatatggaaagagcacagatgtcactcttcgattaggttaattatatggcaaataaattaagcgaaagtgacaaattactaaacagactgtcaaaattgaaattaaaacagtacaaggccacggattttaaagaatatatgataagtgatgatgatccatcctggaaacgcccaaaaaaagatactgaagtttatggattctatgttgcagtttatgaaaaatggaaaaatcgaatcatatgccgtaccttttatatttcgcaaagatggctacataaagagaaagttacagatatatttgaggttaaaaggcaactgtctggatgcagctaccaactgacacggagactttatgcttctatgggtggcggaataaaatgctggacatatgattactcatatcctttcgattatcgaaacaataatgaatggcagattcataagattgggacctttgatgtaagtacagaaggcagcatgtattatggacagcgctggaaaaggagcaactattttatacatacgtctgccggtgaactggcttcactgcttgaaaattctgtttataaatacagtggatttgaatacagtgtttacagcattaatgaactgtttgaatatctgtccatttatgataaacatccggaggttgaaatgatatcaaaaatagggttgtcttatcttctcaaggatgatttaagggtactaagatggtctaaaaaaggaattgagattctaggtataaaaaaatgtgatatcgagcgtttgaaaaagctgcatatcccgctaaaggaattcaaaaagtatagagatctgatatataaatttaagatagaggaccgcagtgattttaatgaactgttaaaacttgtcgaaatatcaagaattaaatatgcggatattaatataagtgtttatgcatttgactattttaaaatgcagggtacttctttgtacataataaaagattattacagattctgtgaagaactaggacttccgatgaatcacagtaacaggtatcccgataacataagagaagctcacgatagattaatgatacagattgagacaaaaaaatctgctaaagatgacctgatgattagagaaagggtaagcaacgagttatctaaatatagatttgctgatgatgattttgttattacaccagcgaattcaatcgctgatctaataaatgaaagtgcaaagcttaatcactgcgtaaggacatatgataaaaggtatgccagtggagaaaccaatatatttcttattagaaagcgtgatgatgtaaacagtccgttttacacattagaactgtcaagtaaaaatgaaataaagcagcttcgaggaaaaaataactgcactgctgttaatgaggttttagattttgttgaagggtggagaagaaaatttaacttcaaaagcagtattttaaaacaaaatgaagatgcttaggaagggatgatatttatgccaaaaccgccggttaagtatttattgttggatattaatgatgttacaaatgtgtgcggttctatatggagtgatgagcttagcaagctgctgaaaataaagccgatctatttacccgtatggttgtgccacaatggtgttttggaaggtaagtattacgttgtagaagatgtttaaatacaacatttacatagaaagtgaggtaattgtactacccttagttatttatgcagaaacaagggaaacagcatataaaaaggcagtaaaacagtttagaaagatatttaaaaagaagaaaattacaagagttactatctacaaagatcattattattttggtggtttcgaatattaaaaaaagaaagaagaggaattttaaaatgagatttattagaaaaattagaagagaacaagaaaaaaaagcgcgcaaacaaatgcttaaggaaaagcgccaacagggattaaagccgaaatatgaatataatttagtaacacataaaaatgatattgaatgggtacctgtaaagatgccaactgtaaagcacagcaatagagtgttttattaaatgcagaaaaaacacaaaaactattttggttaaaaattctctctaatcgcttatgtggtaagggattagagagaaaatataaatgcaatataatatataggttatattgcaccaaaggggtgataaattggcaagacgaataaagcattttggcggtcagcatgaaaccttaccaataaaagacaaaaagcagcttgatgaatttatgttcaatcttttaagaaaaagagataaggccagaacacctgtaaaaaaatatcaagctgatcgcaactggatgatgtgtatgttaggttttaatacagctttcagagccgaggatttacttcaactaagggtaatagacgtaaaaaaaggatacgtgcatataaaggaaaataagaccgctaagatgcaaaattttaagatgaataagaaactgcataatgatgttttggattacataaatagaaacaatctaacagactatgattatttgtttcttggacaaaagaaggttcagaatggtaagaaatacgtttatcctataacgcgacagcgtgcacataaaattgtatctagaaatgcgaaggaagtgggcatcgattttacttttggtatgcacagtttaagaaaaacattcggatatcagtactatgccaatggtggtaatcttctaacacttatgaagatgtataaccacgatgaacccaatgtgacactcctgtatatttgttggggtaaagaagatgcggaaaatgatagagaagcagtttacttaggaggcgtacataaatgataagtgatttttggttaggtgtgatcctaaccattgcagcagaagcaataataacaatcttagttgttgattatttaggacaaaaagaaaaggatgatgaaaatgaatgattacttaaaatatcttcaagaaaaacgtatcgaggtgctaaaagaaattaaaccgatatgttcggcatttggaatagaagactatgattatattgttagcgataaaggacaaacagaaacgttaagaattggaactacaaaaataggatgttcctgtaattctatttttgctgttaagcaggaattagtaggttacttgttcatttgttattttagagaaagaccattaggacacttcaaaacacacgtctttaatgaaattaagtgttattggataggggataaaaatggaaaataaagaaataacattagaacaagcaatagtttttttagaaatgaatgcatatgagggaagcaatgcaaaagctgttttacgtatgggtgatgtacatgaggtattaaaacctataaagggattaatcgataaatcggccaaaatggaaagacatatcgaacggttggagcgacaaaataaaagactgttaaaaagagaagaacctcaagagccatgcataattgagggaaaaaagttttgtcctgcatgtggtgatgaattgaccgacgttgatccaggcttgtttgaatactgtttttattgtggaacgaaattatattagattggagtgataaagatgagtaaattaacaaaagaagagcgtttgttacatgctttaaatggcataaaacaagtattggataatttaggtgttgaggatataaaaaatgaaatagtgctaaaagatggtacaacagaaacaatagattgctataaagaaatcgagacatttgttgttgattttattaataatgaagttgataaagcaacgcctaaaaaaatcaggtatgaaaatgcaccaaagcctagtatggcatacatgtactcctgccctaattgtggaagaatgctaggcgttaattgtaagcctacttatattaattactgtgacgagtgcggtataaagttagattggagtgataaagatgaaaaagataataggtaatttgctgtatgatactgaaaaagctgaaaaaatatacagtttcatgcaaaaaagaaaaatatcaagttttggtggaatgaatttttatgaatggtatgacatagatgtatacaaaacaaataaagataattatttcattcacggttatgtaaaagagaagccatcttataaaccttttattgaggaatacagtgagccggaatttgaaaaactgcttaaaaaaatagaccctgataagtatatagaattaggatttaatgattttgaagaggcttaaaaaagtaccttgaaagtgtgattttacgtaaatcaggggtacggtaactttttttaaaaaaataataatgaaaaatccgctaaaagtgttgatggctatagagtttaaacgatttatgtatgctcacaaaaaaattgacactcttagggattatgtaacttttttataagagattggaggagcgggttagtgaaaattttagatgcatgttgtggctcaaaaatgttttggtttgataaagaaaatccaaatgttacatacatggatatacgcagatacagtgatattttgtgcgatggaagaaaattggaagtgaatccagatgtaataggtgattttagaaatatgcaattttctaatgatgaatttgacttggttgtatttgatccaccacatttaataaaagccggtaaaaattcatggttggctaaaaaatatggattgctggattttgctagttggcaagatgatttatctagaggttttaatgaatgtatgagagttttaaaaccgtgcggtacattgatttttaaatggaatgaagaacaagtaaaacttagtgaagtattgaagtgttttaatcaaaaaccgttatttggaaataaacgttctaaaacacactggttggtatttgttaaaaatgaggtaaaagaaaatgacgtctaaacaaatagcattcgtattttttctaatgatgcttattgcgtttattttgtctcttgttttgggaatcagatatttaattaaaatttggaggaaatagcatggaatttaacacaaaccaaattaatgtcatgctcgatgcgctggagcattacgggaacaacccgcaagttgatatggccatcgaggaaatgagcgaacttacaaaagaactgcttaaaaaccgcagaggtaaagaaaatagaagtgatatagctatggaaatggcagatgtctacataatgcttgaacagcttaaatttattttcggtatcgatgaaactgaactaaaggtcaatgctgaatttaagctgcaaagattgaataaaagattaggtgaagtatatgaacaataaaattaaagagggtaattattatacagttcaatcatttatgagaaacgatttgaaattaaaaggtaatgaacttagcatttatgctattatatttggcttcactcaagatggagaaagttggtttactggttctttaacatatttacaagattggctaggtgtttctaaaaacactgttagaagtgctttagattcacttgtaggaaaagggtttatatttaaagatactcaatctgttaatggaattgtttataacagatataagaataattatagtgtatcaaaaattgatacacctactcaaaaaaatacacaaatgtatcaaaatttgggcaggggtgtatcaaaaattgatacgggggtgtatcaaaatttggacgggggtgtatcaaaaattgataccaataataaagaatataatatattagataatataaataataatattattccatctaaggaaaaaaaaccttatggtgaattgaataatgtaatgctaacagatgaagaatatcaaaaacttaaagatagaaatttagttcacatgattaatgatttatctttctatctttcgtcaaaaggcaaaaaatataaatctcattatgcaacgatttgccaatgggctaataaagataaaaaaacattaaataaaaccactaaacaagtagggcaggtgatttaggtgcgaagtattaaagatatgcttggaattccaaaagatgcagacactagccaatatcaaacagaagctgattttcttaacgataatgtcggagagttaaataaacgtgatggtgtcgagtgtactctatgtaaaaatcgaggatatgtttataaaatggtggatggtcatgatcatgcggttaggtttgagtgtgggtgcatggcaaaacgcaaaacaattagaaacgctcgaaaaagcggacttgaaaaattattaaattatagattggatgaatttaatgttaataaagactttcaaagaactatgaaagataaagtcaaacagtatctaaaatataaatcaaatcactggtttgttatgctagggcaaagcggagctggtaaaacacatttgtgtagtgttgttgctagaaactatttaagcaagaatagagaagtaaaatatatagtctgggatgaatatattagaaatcttaaaaatgagttatatggcgatgattacaaagcaatagataaagtcaaaatggctgatgtattatatattgatgatttttttaaaggtaagatcagtgagactgataagacacttgctttcgatataatcaattatcgttacaacaatagccttgtaacaataatttcaagtgaattattgttacaagagttgatagatgttgatgctgctatagcgggacggataaaacaaatgtcagctgattacatcgtgcaaatcgcttatgatgatgaaaggaattatcgattaaaataatggaagataatcagtggatcacaattaaaagacaggataatgaaacacttattaaagtgtatggcgattatgaattgattggtttctttccagcgggaaatggttctaatatggagatagtgttaaaagaaactaaaaaggaggattcaacaaatgagtgaaagcgaaaagcaatataaagatgaaattatagataaaaatagcatttttgatgaattacttgtacaagatgataaaacacatctttttatagtaaaaacatcaaaccgaggtactgttattgacccaggtgaactaaccgtagttttaattaaggatgcaataaaaaaagatgattatatctttataaaaagaacagaaatttaataaaaactattttgattaaaaaatctctctaattcgttggtagacaaggaattagagagaaaatataaatgcaatataacatcttggatatattgcgtcatttaagaggaggaaacatgggtaaaattattgaatatgaaacacctgaaaattgttctgattgtaaattttatagagaaattaatgataatcaatatggaatttgtgagtattttaaaaagatattagaaaaagaacatggttgctttgttggttgcgatggtattaacaaatgtgatggatgtgaggaaaataatgaaactgattaaattagcaagacgcaaagggaaaacatcaagactcatcaataaggcacataatcaaccaatttatatcatctgttcaaacaaagaacgtgcttatgaaataagtgaaatggctagcaggatgaataaaaatattttattcccaatctgcctagatgaacttattagttatggaaataagggaaatcatgttaaacagtatttgattgatgatctcgatgatatagtgcaaacacttatttatagatatttaattaagccgctaatatctaaaggtgaaatcttagaagcaacagcaactaaaacggatttagcagatttaataggtgcagtatatggagaatgacaattttagtgataaggtactgtctgattatattaaaagatatgaagcggctattaatcacgtatttaaagattatcctaaacagccatcaatttacagtcatgaacgacaggagtacagtggattggatataaatacatatatctatattgcagataattattgtcacttgaaaaaaagactggaggagcgcaatgcaagaagcaaaataccaaataaaaaactggaaaaaatggaaagcaacaaaatatcttcttattcaaacaaagaatgagctaatgaatgatataaaagctattacatatactgatgaacttccgggaggatcacataaaagtattgctgataagtataataagttaatagaagatgtaaagatttatgatgattatattaatgcatatggtttctttataaacagattagaaaacgcaatagcaacaatgctgaatgaaaatcaacgtaaggcagttataatttattctaataatccatataaaggtggttatgaaaaaagaatagaggaagccttaaaaacaggtttctcaaaaagttatttttatgatttgttaactgaatcttatgaaatacttggtagtgttttagatatagagtgcgatgaaaatagaaccataattgaatccgtggacaaatcacggacaaaaaacgcctaaaaatgtgttattatgatattgtggaagttttgaaagaacaccacatcagcagtcaatgaacactttgtcaggaagaaactcgaaagggtttctttttgcttttgtgaagaaggaaatatttatgtatgaaagcgaaggtttacaaatggcaattaaaagattagatcgtgatgggtctcaccgtaagcagttcgaaagaaataaaaagaaaatatacgcaactcaaacagtgtgcggaatatgcggaaagccggtagattttagttataaatatccgcatcctttatcaccgtgtatcgatcacatcataccggttgcaaaaggaggacatccaagtgacattgataatcttcaactggcacactggacatgcaacagacaaaagagtgacaaattattttcaagcagtgggatgcacaaggcgaaggtagtaacaaacagagaccttcctcatacaatcaactggattgcttataaatcgtcaaaataagccatttgagaggtgttttaaatatggggcatgataccccctaaaatctttcttccgtagttcacggcgtactgtgaatattttctcacggataaattaagacgaaaggagtgaaaaaatgacggcatatttaggaatgaaatatttaagaaataaactgatatcaaaaagaccaagaaatgaagaaaagtatctgtattatgaaatgaagaataccatgagggattttaatattactatgcctaaagaattcatatggctaaaaagttgtcttggatggtcagcgaagacagttgattcaatcgctgacaggctttcatttagggaattttcaaatgataatttcggaataaatgaaatatatcagttaaataatcctgatgttctttttgacagtgcgattatctcagcacttattacatcgtgctcattcatatatatttcaaatgatataagcggatttccccgcatgcaggtaattgacggtcgaaacgccacaggaataattgatcctattacttacatgcttagcgagggttatgctgttcttgaaagaaatattcatgatgaaccggtcaaggaggcttattttataaaagagggtacatggttttatgaaaaagataaagcaccttattttatttcaagcaaagccccgtatccactgctcgttccggttatttttagacctgatccaaaaagaccgtttggacattcaagaatatccagagcctgcataggtattcagcagagcgcaatgcgaacgctcaagcgttcagaagtatcagcagagttttattctttcccgcaaaagtatgtactagggttaagcccagatgctgaggctctggacaaatggcgcgctactgtctcaactatgcttcagctcgataaggacgaggatggtgattcaccaacagttggacagtttgaacagcagtctatggcgccgtatgtagaacaactgaaaatgtttgctagtctatttgcaggcgagacaggtcttaccttggatgatttgggattttcaactgataacccgtcaagtgttgaggctataaaagcgcagcatgaaaatttaaggcttatcgctagaaaagcgcaaaaaactttcagtgtaggttttttaaatgccggatatcttgctgcgtgtttaagagataattatgaatatgacagataccagatttatttgtcaaaagctaaatgggaaccgttattcgagcctgattcgtctacattatctgttataggtgatggtgctattaaaattaatcaggcggtaccgggattctttgacaaggatactttaagagatttaacaggtatcgattatagtgaaaatgctggaatcggaaaaactgcaggagagatcgtacagtaatggaagatattgcacctgaattgtatgagaggataaaaagtacatacgaaaatgaaaaagcatcaagtaaaaagctggatgcttttttagaaaaagtaaaaaagggcaatgccgcatatgaagatgtctatgattatgcaggtgaactgggcagatgtctggaaagtgcattcaggcacaatataagcgacgatgtgctgcccgacagcaggatgtattacaatatagcaaaaagaataatcgagcctatgcttaagaaaagtcatgatgatattgcagcacagtgcagtgctgtacaacattcattaaataaaaaagccggcataggattaaatgctgttaaacctgagtatgataaagccagaacagaggcaatcataaattatgtatgcacacgtgaaaaatacagcagtgtagaaaaaagttttttagacggattaagcaataactgtcgcaagactgtagatgattctgtaaagcagaatgctgattttcattacaaaagcgggttaagtccgcgaatagtaaggatctgcagaggaaaagcgtgcaagtggtgtcgtgaggtcgaaggcagttataactacaaggatgtaaggaataccggtaacaatgtatttagaagacacgccaactgcacctgtacagtttcatatgatcctggtgacggatcaaaaaaaattcaggatgtatattcgaagagatggcagaaccaggacgcctttcaggaaagaaaaagattttacctggaaaacagagttgataaaaaaagattaacagatatggaacagtatgcggtaaacagtcatatatcatctgatttttatattatcaacgactgtttaagaaatggatatatattaaatcaggagcagaatacactggtgaaaaacctagattccgcattggagaaactagacagctataaagggagggtcagcagatcagttcagttttacagttcatcagatttagataagtttttatctgatcatgagccgggacaaactgttacgtataaagattttacatcttccactgcttcaaaagaattgtataatcccgacggacaggttcagatgttctggactagtcgtcgaggcagaaatctgataaaatacaataagaaagaacaggaaatattatataaaagaaacagcagttttatagtcttggaaaagagacatattaaaggtgtttattatattttcatggaggaactgtaaaatgaccttaagtctagaagaatggagaaagctgtcagaagaacagaaaggaatacggtataaggaactgagcgatcatgataaatttattgttcgtaccagtactccgccggcttttgaagttaccgggcgcaaagagcttagtgaagaagaaaaaaagagcgcaaaaaaagaatttgatgagtttttagtatattatggaataaaaaaataggaggttaaggtatggagccaaaaagaattggccgtcagactcctacaacctcgttagtgctgccttataaaaaaacaaaaggcaaagaagcagttgaaatttacaacaaaaccggcagaactgcccgggaatggcaggaactactaatttacgatattatggcatacgatgatgaaggcttatgggttcattctacctatggatatgcggtaccgcgtcgtaacggtaaaactgaagatgtgataatgcgtattttatggggacttaaaaatggtgaaaaaatcatttatacctctcatcttatctcaacgtctcattcagtctgggaaacagttacatatctgttagacagtatggatattaaatatgcttcggtaaaagccaaggggcaggaaaatatcagacttttagatgagaatgacaagccctataaacttgatcatatgattaattttagaaccagatcaaataatggcgggctgggtgaaggatatgacctgttaattatcgatgaagcacaggagtacactattgaccaggagtcagcgttgaaatacactatttcagcgagttcaaatcctcaaattattatgctgggtactccgccaacagctatttctcatggtacagtattccagaaaataagagaaaaggtattaagcggtttttcgaaaaataccggatgggcggaatggtctgttgatacgatgcaggatccaaagaacagagaagcatggtatgagacaaatccctctttagggcaaggacttacagaaagagttattgaaaatgaaaatacgactgatgatgtcgattttaatattcagaggttaggtcactggctgtcatattcacaaaaatccctgtttactgaaaatgaatgggattcattgaaaataagtaaaataccgaattttaaaaacaaactgtttgttggaataaaatttggagctgacggacgacatgctgcattatctatagcaaccaaaacagatgataagatatttattgaatccatagactgtcaaagtcagagaaacggaaatctgtggatcataaattttttaaaaaatgcagatatagaaaaaattgcagttgacggagcaggagctcaggacgttttaaaaaaggatcttaaggagtacggtataaaaataaaaattgtgcttcctaaagtaaaagacgtgatagtagccaacaacatgtttgaacagagcataacttcattaaaaaatatatgccataatgggcaggaatcattaagacaggtcgttacaaactgcattaagcgtgctattggaacaaatggcggttttggatataaagccttaattgaagaacatgaaatagcactgatggacagtgctgttcttgcacactggctatgtgcatcagctaaagaaaaaaagaaacaacgtgttaattattaacgaaagcatctattttatggatgcttttattattttaaatttacgtacactaaacggttaattaggaggttattagaaatgtcagaatttaaagcaattacaacacaggaagaatttgaaatgcgtttaaaagagcgccttgaacaaaaagaaagaaatgtattaaaaaaattcgagggatatacttcgccggaagatttagaaactatcaaaagtgattatcaaagtaagattgatacattaaatcagtcaatcagcgataaagacagtcagtatagcagtgaaatcgagggttatattcaaaaaattgctgattatgagaccgactcagtaaaaacgagagtggcaattgatatgggtattcctttgaaactaaaggacagacttaaaggaacaacggaagatgaaataagagcggatgcggagcttttatccggtctttattcccctgctccgcctttagcatcgtcagaacatactatgacagcagaagatgaaaaaaaattaaaattagaaaacggttataaagaaatggccaaaaaattaggaggttattagaaatgtcagaaggaaaaattttagaagttaaaaattataaaacagtttttacaccagaattagtaactgatcttttttcaaaggtaagaggtcactcatcattagctaatcttgctaaaaaagagccgcttccttttaacggtaaagaaatgatgatctttacaatggatgatgaagtgaatatcgttggtgaatcaggaaagaaaacaagaggatcagcagatatcagcactaaaacaatggttccaatcaaaatcgagtacggtatccgtatttcagatgaatttatgtatgctactgaagaaaagaaaattgatattctaaaagcgttcaatgagggatttgctaaaaaagttgcacgaggattagatattatggcaatgcatggaatcaatccaagaacaaaagaagcatctaacttgattggtgataatcatttcgatcatggttcgcttacagttacaacaactgccggtgaagaagataaggacatcaataaggcaattgccttatttgatgaatcagacgattttgaagtttcgggatttgcaatagcaaaagcattcagaacttcattaagtgaactcgagtataaaaacggagctgccaaatttccagaattaggatggggaagtaatacttcagcattacgcggtttagccgtagatgtcaattcaacagttgcatttaatgattctaaggatttggcaattgttggagattttgcaaactattttaaatacggtattgctaaagaaatcctaatggatgtgattccttatggagatcctgataatacaggattagatttaaaaggaaataatcagatttttatccggtcagaagtttatttaggttgggcaatcatggacgagaaagcttttgccagaattttaaaaactgaaggataaggaagtgaaagatgatgaagcctttcgttacattaaaggatatttcgctgttgttcagagatcttagtagtttagaagaacgcaaggcctcagcacttttggagattgtttctgactctcttcgccaggaagctaaaaaagtcggaaaggaccttgatgaaatgataaaaaatggcgaagtgtatgaaaatgtagttaaatcagttgcagttgacattatcgcaagaaatttaatgacctcaactgatagcgaacctatggaacagttttcacagtcggcattgggatataccgcttcaggaacatatcttgtacccggtggagggctgtttattaaaaaaagtgaattatcaagactgggacttaaaagacagaggataggagtactggacatatggggattaaaggaataaatgtaatcttagttgaaaagattgaaaccggtaaagacagttttaatgagccggtgtataaagaaatcgagaagtgcataaaaaatgttcttgttgccccgtcaacttctgatgatattgtcactgctcaggatctgactggaaaaaaagccgtgtacactttagcaatcccaaaatgtgataacagcgtttgggaagataaagatgttatatttttcggcaagagatggcatgtactcggtttcactattgaaggaatagaggaaaatattccgctttgctggaataaaaaggtaatggtggaaagatatggctaaaaccagaattgttttaaacagaaaaggggtaggaagtctactgaaatcaaaagagatgatggcagtgtgccttgaacatgctaatgcaacatgccaaagtgcaggtggtgtgggttacgaagtaacaacatttaccggaaaatcgcgtgtgaatgcctctgtaagagcaaataccagaaaaacaatcagtgataactacaaaaacaacacactgcttaaaagtctgaggtgaaatctgtgattgaagaaactgtattaaattatctaaataaaaaattaactgttcctgtctttttagaaaacagggatatcgaagaatatgtcgtaataggcaaaacaggaagtggaagagtgaattttgctaactcagccactttttttctacagtcgtatgcatctaccagatataaagctgcattgttaaatgagcaggtaaaaaaagcaatggacgacttggctgaactcaaagaaatatcatattcccggttaaataccgattatgattttacagatacagccaaaaagaaataccggtatcaggcagtatatgatatcggtttttattaacttgtgaaggaggaaaaataaatgtcaagtgatgcaagtaatgtaacatcttcaaaaccatctgttggcggtgctgtttgggcggcaccgttaaaaacagaaattccaaccgatgcaaaaacacctttaaatgaagcttttaaatcattggggtactgttctgatgacggattaactaactcaaacagtccggaaactgataatcagaaagcatggggcggtgatgtagtactggttttacaaacaagtaaagaggataaatttcagtttaaattgattgaatcgcttaatacagatgttctaaagacagtgtacggcagtaaaaatgtaaccggcacccttgaatctggattaaaaatagctgcaaaaaacgatgagcctgagcagttcgaatgggtgtttgaaatgattttaaaaggcgggattttaaaaagaattgtagttccgtgcgcatcggtaactgaaattggtgatattgtttataaagatgatgaatcagtcggttatgaatgtactattgcagccgttccggatcaaaacggtgcaacacattatgaatacttagtaaaaaatactgaataaggagaatgctagatgatcaaaggtgaatcaaaaacagggtttaagtttaatatcaatgaaaaatttattgactgggaacttcttgaaatgatggcagaagtagataaaaatccgattttaatgattagtattgctaaaagactgttagggattaaacagtataatcgtttaaaagaccactgcaggactaaggatggaagagttcctcttgaaagaatggaagaggagattttttcgattattgattcaagcaaagaaacaaaaaactaattatcctcgccgacatgataaatactgatgaatcagcagttatttgtgatctggctgaaacatacagtatatttgattataagtcgcttccggtattaacggtcgcgactttttgtgttggtctgagggaaaattcaagaataaaaatgaaaaaaaacaggcttgctgttccttttgaaactgtacttcttggtgtgattgcggacagccttaaattattagtctggacaaagtctaaagatgctcagaaaggatttaacaggcctaaatcgatcgttaagtcactgtttgaaaacgaatctaaagaaaatatatctttttcaagcggtgaagaatttgaaaaagcaaaattgaaaattttagggaaggaggcagatgtatggcaagcggaacagaattagcaaaagcatatgtacagattgtaccttcggcaaacggcattaagggttcgttagaaaatgcgatgggaaatgaagcggatcaggctggagaaaaggccggaaattcaatcgcatctaaaattaaagggataatcgttgctgctggaatcgggaaagttcttgcatcgtcattcacggaaggtgcagcgcttgaacagtccataggtggtattgaaacactttataagggaagtgcagaaaaaatgaaggcttatgccagtgaggcgtataagacttctggagtaagtgctaatgcctacatggaaaatgtaacgtcattttctgcttctttgatttcaagccttaaaggtgacaccgaaaaagccgccgctgctgctgaccgtgcaatgcgggatatgtcggacaattccaataaattcggtacaaatattcaggatatccaaaatgcatatcaaggttttgcaaagcaaaattatactatgcttgataacctgaaattaggatatggcggaacaaaagaagaaatgcagcggctgttgtctgatgctcagaaattgagcggacaaaaatatgatataagtaatctcgcggatgtctacactgcaataggggttatccaggacaatctaggaatcactggaaccactgctaaggaggctgcaagtactttcagcggatcgtttgcttctatgaaagcagctgcacaggatttcttaggcaatgttgctattggcggtgatgttaccggtactctgtcaaatcttctatcaactgcatcaacttttttgtttgataatgcaattccaatggcttttaatattgtttcgggatttggaactgctcttgttgccgcagttcctcagctggctcaaaagggatacgaattgcttagcgggcttgttgatggatttgtaaaaaatatacctgtggtgcttccacggattttacagtttgttcaaaattttggtgtcggtttagctcaaaaagcacctgaatttattaatatgggttttgacctgttaagccggctggtaagtggaatagtgagtgctgtacctattttaatacagtacgttcctactataatttctacttttgcaaatataatcaatgaaaattttccaactatattagccaaaggggcagaaatattatggcagctgattaccgggctgttaagtgcgattcctactttagttgctaatataccgcagattatacaggcaatctgggatacttttatggcttttcagtggctgaatctaggtgggcagataatgacatttttaggcgatggtatttctgctatgtttggatttttaggtgaaaaaggccttggtgcggttcagagtattgtaaatacgatactttctcttcctggtaagctatttacattagggaaaaatgctatttctcaaatggggagcggtatttcaggaatgggatcatggctaaagacaactgctggaaaaatcgtaacatgggtagtaaacggtgttaaatcacttccatcgaaaatgatagatgtcggtaaaaatgtagttaaaggattatgggaaggaatcaagaacgttaaagattggatactagataaaataagcggattcgttgacggtattgtaggaggaataaagaaattttttggtatacattctccatcaagagtaatggccgatgaggttggtaagtatctccctaaaggaatggcagtaggtatcgaagcaagtgctgatgaagtttacgatgaaatagataagctgtctagaaatacactagatatcgcagctgatgggttagaattcagtaacattgatatgagtgaaaacagcagcgagcttagcggtatgcttcaaataatcattaaactgttgaaattaatcttaaacaaagaagatacaactgttttgaatttcaacaatagagaagttgcccgtgctttgcgtgaactgggggttgtttttgaatgacggtaaaatatataaattcaaaaaatgaggtactggagtttattggtgccgatatacttccaacaagcggttatttgcaccagagaaaatggaatacaaacaaggaaaatgatattacagttattgataagggtgactgtacttatactataacccttacattgaaaggcagtctggaacagagaaaaaacatgcttaataaaatatgcgatatatttgagtatgattgtatagttaagacaccaggaacgcttcattacggggattataaaataaaatgctatgtaatatcttctaatacaagtgttgcgggtattcagacaagaacaaatattgaattaggaatatactgtccaaaacagcactggattaaagaaaaaacatataatctggtaatgtacagtgattcgaagaatgacacaggtataaagcagtacagctattgctatccgtatgtatattcatctttaaaaggtgcagttcaaataatcaatgattccccggcagacagtgattttatcataagagtttacgggccatgcagtaatccgtttattaaaataggagaaatactttatcaggtgaatactacattaagtgctggtgagtacatggaaataaactcagaggaaaatacaatatatgccttttcagattacggtgaaaaaaggaatctttttaatttcagagataaatcgcgaggcgatttttttacaaaaattccatccggtcttagtatagcaacatggaatggaacatttaaagctgaaatagttatatttgataaacgtggtgaaccaagatggatataatgaaatttatatatacggattccaactatacggagctcggtgttttgaaaaatacgtctattgattttgaagttggaaaattcaaaactgcgactaatgattattctttagaaatttcgataaatgcatgggataaagcatttaataaaggttctatattttactcatcggaaagtgaattcggtggaattattgacagtaaaaaggtcgatacatcaaaaaatgtaattgtctttactggaaaaacatttagaggaatgctggaaaaagagtacatacagcccccggaaggtcaggcgtattttgtagcaaaaggcgaggccaacagtgtgataaatgagcttattggagacaacttcgatagtctttttactgtagataatgttggcttgagtgatataaatgttaattatcaaattagagatctgaatcttttagatgcgcttgaaaaaatgctttataaagcagatattccatcaagacttgatattgtgtttcatgatggaaaagtgcatattcaggctattccaattgttgatttatctgaactgcttcaatatgataaatcgtatggtataacaatgatcgcacagactcctgaaagcagttataaccatatcattgctttaggaaaaggtgaattgacagagcggttaagggttaatctgtaccttcaaagtgataaaacgtggtcatcatcaaaaaatgatgattataaagggctttgcagaaaaacatatctgtatgacaattcgagtgaagatgatgaaactttacttattgaaggggcagtagaggcagtggaaaaagaaaatggaagcagtaccgttcaagctgtattttcaagcgatgatgcttcattgtttgatattgtaggtgcaaaagaggaaattacagagctttcatttaaagaacagattactaaaaaaatactaaaagtaactgttaatgatattgcagcaaactgtaaatttgaatacaaggtgggtgaataaatgttagaaagtataacactgaacggatttaatgttcaggcttcggtagatgcttatcttcatcactgctggtttggctatgaaggagtatttaaatatggagaagaaataagatgcgaaactgtaagcaacaacattttaaagttgtacgatggactttttgtcaatcagggcagattttatcgtattgttcccggatcatatgaagaagtaaacatttcaaacggtatagttggtcaaaaaagatatgatctgatagtttcacattttgagactaatggagtaacagaaacacatgatattagagttttaaaaggcgggaatgatggggaaatacccgaacatactgtgaatgatacatttaacggtggaacggtgaatgaatttcctctttatctggttgaaattgatggaataaacattactaaagtaaccaggcagtttaagtatattatttcatttcatgaagctttagaagctataattaacctttttaatgcagcggtatataccggcgatataaatattaaagatttaattagaaaattagatgtaaacagagaataaagaaaggaaaatttaaatgagtttaaaaacagtacaggtaattattaacggtgtctcaacgacactgaatttaaacagccagactggtaaatatgaagcgacagtaacagcgccgaatacttccagttttaatcagccgaacgggtattacaatgtaacagtaaaagctactgataatgcaaataatattactacagtagatgctgatgatccgactttgggaacaaaacttcgtctggtggttaaggaaagaactgcacctgtaattactccaacctatcctagtgctagtgctacattaataaacaacaagcctacgataacatggaaagttacagatgcagacagtggggttaatccagattctattagtattattattgacagcggttctaagattacatccggaataactaaaaataaagtaagcggaggctatgagtgttcttatactccaggaactgccttaaatgatggaagtcataaaattaaatttgatgcgagtgataacgacggcaatgcagcagttcaaaaatctgtatcgttcaaggttgatacagtaccgcctacattaaatattgcaagccctgctgcgggattaattacaaacaatcctaaagtgacattaagcggtactacaaatgatgctacatcaagtccggtaacagtaacggttaaattgaattctggaagcgctgcaaatgttactgtagaaagcaatggttcttttactaaggaattaaccttggtcgaaggtacaaacactattgttattaccgcacgcgacagtgccggcaaagaaacagtcatttcaagaacagttacccttgataccaaagcacccgtaatcactgatgtagtaattactcctaaccctgttgacggcggtaagacatttaccatcactgtaacggttacagatgcttaaatatggctgtagaaagagtaattggaaaaacagacagttttgaagtgatttttgacagattgaatgataataactggacggtcaatgtgccgtccaatattatcggtgaatatgtaatggatctgtatgcatatgatgaagctggaaatcttggatttttagcaactgcgatgtttacggttgatacatcaaatttgtgctttcatctttcaatcatcaaataccgctctgaaatctgttttgaaagtgactatatatgcacagtcaaggaggtacttccatgtgtgatgaaatagctatgctgaaaggcgaaaaaagaaaaataagactgtatgtgcacagcagaaaaggtgatgtctttgtaataagaaatgcatatgtagagatattgcaatatggtgaattaataaaggcgatagaatgtacgattgatgaacatgatcttacatttatgcttgcacttgatgaagcaggaagctacagcatgtcagcagtatatgaaattgctgatgaaataattaaaaataaatttaaaattgaggtgaggtaaatggcaaagtaccgtatatatgatgtaacactttctaaaaaaactgtcggtcctggcgaaagattagttgttcaggttgatataatcacatgggactggattaagaaaaatttaacctggggaagtcttaaggaacgtttcaaatggggtgatttgtttggcagttagcatccctacaaagattacagttccgcctgacctgaatatgagcgacccaggcgatatcgcaaaagtatggagtgaaattcaaacgattataacacagtttaacaatgttatcgatgtgctcaatgattacaatgaaaagctgaataaagcggtatattatgacgagagtgttggatgatttaaaaaaacaggagggaatatgggtaaacttatagattcaactggtaaaaaaattttgttgggaactgttttatataacggtgatacaacaagcaattttactttaaatgatgattacatcaattatgattatatagaagttgtgtggcgtccgcatcctactttggggcagtgttcggatacaatgattccatctaaagacagtaagctgcatttagaacgcacacaatccataaacggagttactactgtctatcgctgccaaatgacttttagtggcagaaacgtgactcttacaggtcgtacacaggttattaacggagcatcggttgatgctgtggaagaacatattttaagagtaattggttattaggacactgaagtatgtgtctttttatattgcctcaggatggcataaaaatcgtctggaaagaaggtaaaatatggatttaggttttatttcgaattattttgttccggtcgtaatggccggatgtctagcaactggatatgttgttaaaaaatggataaaagatgttgataataaatggattcctacagttgtgtttttcgagggtgctgcattaaactgcatcgtatccggaaatgtaacagtagaaacagttgtagccggtgcagtatgcggtttagctagtaccggattgcatcaggcttttactcgaattattgaaaataaaaaagaggagtaacagatcctgatgcaagaatttttaatgagtacatggtctattgttttaactgctgcggttggttatcttgtaactaattccagagacagtaagaaaagtcgaaaaaaactcgaagaaaaaagagagcaggagaaattagaccagactaaaagacaaattgttatggaagaggcgctatgtgcaatgttacatgaacgtatcgttcgtttttgcgagagactgctgataatcggttatgttactgctgatgatctaaaggaactggattacctttataacccctacagggctttaggcggtaatggaacagtagaaagattatataacaaagtgcagcagcttccattgagagtagaaaacggagcggaatgattccgctcttttaaattaaattcaggaggaaaaacaaaatggaaatcaaacaaaatttagtaagctcaagcaaatatgatattaagtgtccttatgaaagaacaccacagttttacgttgtacacaacacatacaatgatgctccagcaaaaaatgaagtttcatatatgattgggaacaataacaaagtatcatttcattgggctgttgatgatgtagaagccattcaaggtttacctgagaatagaagtgcttttgcttctggtgatggtaaaagaggacaaggaaatttatatggtattcatgttgaaatttgctattctaaatctggtggcgatagatttaataaagctgaacaaaatgccgctaaacttattgcagatggtttaaaagcacatggctggggtattgataaagttaaaaaacaccaagattttgctgataaatattgtccacatagaacactagatatggggtggcaaagatttttaaacatggtacaagctaatcttgacggaaatgctcaaccattaccacaaccaacaccagataatggaacatcagtaaattatcaagtacgaattactgcaaatagtggattaaatgttcgttctgctgcttctgctagtgcttctaaagtaactgcattagctaaaggaactgtagttgctgtagatagagaatctaatggatggttacatatcagtcaaggatggatttcggctgaatatactgaaagagtttctagcggatcttcagttaattataaggttaaagttactgcaaactcaggattgaacggtcgttctactccaagcacttcaggaagcaaagttactgcttatgctaaaggaacagtcttaaacatttcaaaagaacaaaatggttggggatatactggcgcttgttgggttaaattagaatatactgaaaaagtatcaggaggatcaacttctaatgcatcaaaatcactaggaacatatgaagtaaccgccagtgatttaagtgttcgtactggtccgggagaaaactttagaagaaaaacatataatgaattaactgaagatgcaaaaaaacatgattatgataaagacggatgtatcagcgaaggtacaagagtaactgtaaaagaatggaaaaacggatttgctcgtattcctagcggctgggtaagtggcgattatctaaaaaaggtatagtaatgaaacgtatagaagtatctgttttagccgctctagcgctattatcattattactaggaattgccctagtacaagaaaaacaaaccactagaaacctaaaaaccaatctagaattaacaaagcaggaactctatgatgctagaggcgatagagattattatcaagggcagtataaaaaatattttgaattgtccgaagagcttaaaaaccaaatgggtgtattctatgaataaggtttatttgaaaacaggtgccgaggatatctcgggcactcagttaaacagccgtctggaatataccctagtagctgcggggattatgtacagtataatcagcaacggctataagcagttttatgtaaacaataaatatataaagcttaacaccgcttccaagtgaattggtgtttttttatttcctctgtgttttttattaataaaccaggttattaataaaattaccattaaaattttatttaaccacttgaaaaaagttaaaaaaagtagtatatattatatgaatagaaacctccttgcttaactcgcaggtcttttgtgttctctgttcgtctataatgtcatataattttatatgagagtagtatactgacctacttccccttggagtcgttaaccaaacctgtgcgggggcgcctagaaaagcatgggtggcggtagttgtttatacacaatgtactgcgtcagtaaacattttatggtagagcgctagttcggctagcgctttacttttgactttttaagaaagggtggtcttgtgtactctatagaggagttagatagaatagtattaagtaaacgactacctaaagtagataaaatttcattaaagttatattgtgattattttgaaagttacattgaaaaaaatacatatttagtcgaaatagatgcaaaaaaatctttttttgtgaaggtggaggctaaacatgtcgcacatattattgatttacacgcttttcatgattcagctgtaagaaataaaaaaattcgtttttccggggctttttcaaagatagatggttattcaaatatgaaaaagggagttattacaattgacaccctaataaattcaaaaaacggagaggtctggaagagaagaaccatacgggatagagtgataggatttgtatttattagagaagctcttttaaaagggcggtggtattcttttgataagtctaaatgtaggaaggatactaaattaaatcctaaatatgttgcatcatataatgtgggagaaattttttataatttttgcatatctgaagatgatgagaacaactgtttttgtatttcaaatatagttgtgtataaaaataattcctgggtagaaaatcaggagttgttagatgtttcaagagtatgtgaaattctttcaaacggaaaatataaatctatagtttgtcataaggaatttgttaaatcaaaattaaagaataaaaaaacagcatattcagttactgtagatgaatatactcatgataaaattgcgaaaaaaagttattcatttaattccacgcggattagtgataatagatatttaatagaatatttgaggatagacataataaataagtacataaagaaataaaatttaatgtttatttaagttcaaacctaggtctaattgatctaggcttttttgtataaagaaaaacacagtgacatgggaatgaacactgtgtttttagcataattttgggatgcgtactatgcttattaaaagtatataataatttattattattttcaataaactttatataaaaagaatacaagcccaaaaacgggagaggtgaacttgtactcttagtataactatgaatattgttaatgggaaaggaacaatattctattgtacaaaaataatatttgtacgcaatctattctactacattatacaaaatatgcaaatgtattaaacttttaaataaaagagcacaaggctctagtgaggagatatctcttttgtgctctttgtctagcaaggctaatgggaaaggaaagccatctaatcttgcatccattttaatttcctccatttttcttattatatagcgatattaaagccaagtcattaataaaattactaacaatactataactataatgttaagtatcattttaatcttttcatagtgtttcatgattatcgctcctttcgtttattagaaagatatgatataatctttaagagagaggggaagtcatttccccaaactctttatgattgctaatattagagttattatctctagtattaacttgaggagttccaagacttgtttgacgattggtttggaactctttttttgtttcttcatatcctatctcctttctacacttatataatacaccaaaacgtgaactttgtcaatgtttaaatacatttttatatgaattattttcactattgaatgaactatattcatgtgataaaatactaatgaggtgatatgtaatgaataaaaaaataatatctttattggcattgtttggattcaatcaaactgattacgctaatcacatgtcaatgagtaagagtagtctaagtaacaaaatgaaaagaggctcatatacggcaaaggatttaattgagctggctgaaatgacagggaataggcttgcaattgttgatgaaaacgacaaagtaataattgaatttagtaaggaagatttataggcaggaatatacatataaatgtatatcgttcaagtctggtcgtaaatgatcagtctttttttatttttcggaaattttttattaaaaataaaaaaaacaatgccataaaatatgacactgtatcttttaataataactttcgacatttcgtattatacgcttttgtttttctattgcatgtttacagtctattattttttcttctttatcctgtaaattagaaaattccaagaattttagtttttcttccagtacctttaattttgtttttgcctcttgcagttttctgtcttttaaattcatatttaacacctcatgcttattataaatattttgtgtattaaagtcacttatgatgtaatctaaagtctaattattgattaaatatttaatttttatttttttgtgctattatcgatattaggggatggatttgtcataaatatacgtatacacaaaccgttaacactaagctttttaatcctccctcatgtctggaactccctatttccagacgttttttttattttatatttaaaaaaattactgcacggttactgcacggcttgaatttaaacaaaaaaaccgctctagaatgcggtttataggcttattggcatcctcagtaggaatcgaacctacaacttaacctccggagggttacgtgatatccatttcactatgaggacagtacttgatgattatatcatcattactctaaaaaataaatattaaaaaactatttttctgaaataatttgactagcactgaagaataactgactaggtaagtataaaatccaaatcaaaattctaaatacagcagggaccggtagattgatattagtaagtgcaacaaaaaaatcacaacataataaaagaaaaattgctataaataaataatattgatgttttgattgataacgtgatttaaaactgtaataaagattgtgtaaacttagtaatgcataatttgacgctaaagcaataagaggattaacaggccataagagtattgcgacaaaaggaaaaaaagtatattgatctaaaagcttcatatagttgctttgaacaatgataaagcatagtactccagcaagctgattattagtgaaaagtaaaaagtagtcagcaatgcaggtgaatagacttgctagaagagctgttttatttacagatttaacgagtaggtaaagaaaattattaaaaatagttagatatttaatcaagcagctatctatattattgaaatcaagataaacaaaaataaaacctaaaaaaagattaaatagataaaacatattttatcaccagttgaattattaactaatgatgatgaatttaacagaatttctctactaattacttagaatatggtaaaatatcctaaatgttataaagagaaagtaggtgtaattatgtatggtaagtcttagtgctaaagcagtatgtatcattgattgtcataataaactagtctacatgaatgatttttatcaaaatttatttaatgaagaaaaaattggttataaaacaaaactaggggatgctgtaataaatgagataaataaagtatcttatcatacaattcaaaagacagattttaaagttatcaaagaggactttataatcaatgatcaagccagctatatttatacacttgaaagagtaaatattaattctgtaagtcctgtattagaatcagcattatatgatgaattagtagaaattaatcttacaagagatacttataatattttattttatcgtaaagataaatatattattccagcattatcaggtagttttagtaagcaaatcagagaaatcgctcagaaaattattcatccacatgatcaaaatgattttttgcagttatttaataaaatgaaaaataatcatggggattttaagccagttatgggaaggtttaggagacttttaaataatggtgaatacagttggatcaatggtattttgattgcaataagtaaaggacaatttagtgatactgtttacatgtgcctttttcaagatgggggattaactccgataaatgttgaaagtacaaactataaggaatatgatcaaacaaccggtttattaaatgagcatagttttttgaaagcggcaagatttttattagaagaaggagataatgataactattgtttgattgcgatagatattgagcattttaaattatttaatgactggtacggtcgtcaaatgggaaataaaatattagggcaaattggcctagaattacaaaagatacaaaatgaatttaaaacagtagcaggatattttggtggtgatgattttgttgtcattatgccaaatgaacgaccattgattgataaattattgactgatttaatcgcccatataaaagtagtaactgttaatccaggtttctttccaaaatttggaatttatattgtaattgatggtgaatacgttgcagcaatgtatgatcgggctttaatcgctttaagttcaataaaagaaaattatacaaaacaaattgcttactatgacagcaatataagacaagattttgaatatagccaaagtattttaatggatacccaacaagccctttataaccatgaatttatggtatatttccaaccaaaatgtaatatgttgaatggaaaaattgtaggtgttgaagcattagtgcgatggaatcatccaaccaagggaataatttcaccaggggattttgtttttattttagaaaaaaatggatttattgtaaatttggatttatttgtctggcaagaaacttgccgtttgttgagtaattggcttgatcaaggaaatcaaggtgtaccagtatccgttaatgtttctagaacagatatttatgcaattgatgtagtaaaaacatttaaagaactcgtagctgaatataaactacctgtaaatttaattgaaattgagattactgagagctcatatgcgagtgattatgaaattatttcaaaagtggtagatgattttagactagctggatttactgtactaatggatgattttggaagtggttattcttcattgaatatgcttaaagatgtaaatgttgatattttaaaaattgatatgaaatttctcgaattacgtgaagacagtattgggcgtgggattggaattttagaggcaattgtaaaaatggctaaattgatgggtttacgagtaatcgcagaaggtgtggagacaaaacagcaaattgatttgttgaatgaattaggctgtatctatggtcaaggatattatttttatcctcctttatcagttcaggaatttgaagctattatcagtaattctgactttgttgattatcgagggataatgttaaagcaggttgatcaagttagattacaagatatttttattaatgatatatcaagtgaagcaatgttaaataatattttaggcgggattgctttttatcaagtttcagaggataaaatatcgataattaaagtaaatgatattttttatcatattactaaaattaatccagcggattttgaaaatattcgagatagaataattgaatttgtacatccggatgatcaaaatgaatttattagtttatttgatcaagcttatcaaaacccaataagtggtagtgaagctacgattcgttattattcattaaaaggaaaagtttcatggataagtttaagagtttttttcttacgaaaacaagataaaagtctgattttttatggtgctatgaacgatgttacaaaaaataatttgcaagaacaagagcttaaagcatcaaaacaaacaatcaatcaattgttaggttttcctgaagatacggctgtagaagattatttaaattatcaagatagtcaaacagcagtttcgatgttttcaaaagtagttcctgcgggaattttaggatgttatcgtaccaaggaattgccgatttattttattaatcgggaaatgttgagtctacttaaccttactacaatggaagagtttaatcttttttgtaaagggcaaattattaacattattcatcctgaagatcatcaaacagtatatgcagccattggattagaagaagatgaaggatttgaatataccgttcgatatcgaattatgaaaaaagatcagacttggctttgggttcaagaaaaagggcgaatcgttaaagctaaagacggactattagcttatatctgcgcgattgtagatattaatgaaacaatgtcatcaaaaatcgagttagaaaaaattaatcaacagttaataaaacaaaaacaacaactttcatttttaaatgaatgtacgttaggtggatattttcattgtaaaaacaacagccaattagaatttgactatcttagtgaaagttttttaaatattgttggttttagccaagtggaaattattactagctataacaatcaattagtacaattgattcatcctgatgatcgtcataagattactgataaattaacaggtaagagtacatcgattaatttgatgtatcgaattaatagtagtacaggatatatgtgggtaactaatcaattagaacttgttgctcatcaaggaaacctgatttggcgtggaatcgttattaatataaccgaacgtgtagaactaaaaaatcatctggaggcagtagtaaataattcgcctggagatatttttatgatgacacctaatcatattgaattttttagcagtaatttatcaacatcgttaggttattgtaaagaagaatattgtcagctgacaaagcggagctatgatttaattgataaacgtgatattgattacgttaatgaagcatttgaggcagcctatagggaaaaaagaccattagatgttatctatcgtgttcaacataaaaatgggagtattgcttatattcaaatgattgcaagttattatgaagacaaggctggaagaccatatttttatggtgactttattaatattaccgaggtagtaaatgcacgaaaaaataatcagttagttattgataatactatgaccgtagtctttttaattcgtttgagagatgctcctccaaattttgaaaatccagaaataaatatgatttcaatcggtattttagaaaaatatggatatacaaaacaatcgtgtatcgaagcaatgaaaaaaggtggaaactgcggattgatcaataaaaatgattatgcagcaattaaagatgactatatcaaagcggtagataataaagaagattacaatgcgatttatcgatttgaattggaacaaacaacattgtggatggattccaaaacaaaatatttaaatactgaaaatggttatcgaacatatttgtgtgtattaaatgatgtaacatcaatgaaacaaaaagaagaggagatttggctgtcatcacaaattcttgatcgcgttataaaaatggcaaatctaaatatttggcagtatgattatcaaacaaagcagctgattttaatgaatttagagagagatagttttatttatcaaatattagatcttccaaggaatgaagatattattattgataattatttaaataaaatcaataatattgaagtaatgaatgaacaaactaaagaaaaaataagggaacagctgattgctcaaacagtacagaataaatttagttatgaattaccgcttacgcttaatagtaaaattatttggatcaaagtagtcggagaaactatttatgattacggtgaccgtcctttgaaattagtaggttattttaaagatgttactcttgagaaatcatcatttcaaaaatatttagaaaatgctaaaacattagaagcattacaagaaaaatctttttatgagttgtcaattaatttaagtcaaaatcgaattattaatactaatatacaggaggatgatttaagttttataaacagcagttatagcagctatatcaatagcataactgaaaagattattcaaaaagaatatcaggataaagttaaagaagtcttaggattagaggcaattctcactcgctatcaacaaggtactacaactaattctgtggtgtataaacgatatgttgatggtgagtattattggatggaggcaacttatcatattcttgatctgcaggaaaataaagatattttttgctatttatatgtcattgatattgataaacaaaaacggcaagaattggctttgaaaaataaagcagaacatgatggtttgacaggattatataatcggtctaaagctattaatgaaatcaatcagatcttgcttagtaacgaaatgacgtgcggagcattattgatgctggatatgaatgattttaaagaaattaatgataattacggtcatgctattggtgataaaataattactaaaactgctaaacgattaaaagagatgtttagaaatgatgatatcttgtgtcgactcggaggcgatgaatttatgattctatgtcgcaatatcgatgaaatatcaatccgaatgaaattagaagatgtcacaagacaaatgaaaataccatatttgattgaggagtaccaaattatggctccattatcgattgggtttgtgatgatccctttgtatggtacgacattcaataatctttataaaaaggccgatattgctttatacaaagctaagcaggatggtttggctagttatcggatgtatcatgatgatatgaataaaaaagctctttagtaaatctaagagctttttgttgttttagcattagtgggaatcccacttacagcttcaatattgatggagtagtgatgcttatctttagtaaaactgatgttatagtagatattgctactgtcattatctaactcaatgtttaagttactaatatctgattcagtgaaattaaaataatttaagctaattgttttagcttcatcactactgatgatcttatcataatcattgagaggagaaaattctttaactaagatttctttattctcaattgttccatcatgaatatcaatttcatattcataagtgtaattatcatcttcaaacaaatagtgatatccattttgatctttaccttgaatcgtaaaagtaatatttgcttcactgacttcagcgtcattcaatgcgatttttttagctttatcttcagcaattgttttattagaacagccggttactccaattagtgatgtcacaacagtgatgagtaatattttcttcatagcaatctcctttagcatatgttatcacatttaaaaaaagatgataatagttatgacgttttttatcaaaatttgttagaatatactaaagtaggtgagagaatgaaacatatatttattattaaacctgatcaaaataataagaatattgaagcgatgatcgttaaagtgatgcagggatatcgttatgagattaaatatacacattatccacgccatgcaactctcttagctaaaagttatagtggatgcaattaccgaatttacgcagtaggtggtgatagaatgattcatgaaatagttcagggacttgtggggagtgataatgaactggtagttattccaacaggaacaggaaatgattttgtccgtacgattgctgatgaaaatgatccagaaaagttattaaagaaatcattatcgttagcggcatcagaaattgatttgattaaagctaatgatatttattgtattaatgttttatgctgtgcttttgatagcgatattgcaaataatgttcataaatatagtcaaataaaatatcttcctcgttctttgcaatatgccagtgtattagttcggcgaataactcagtattgtttgtttccaaccgctttattccaagatggtaaaaaattttatgaagggaatttaatcgtcggggctttttgtaatggaaaatattttggaggtggttttaaaatcggtaaagaagctcaaattgatgacggaatgattgatattaatcttgtttcaagtcttcacaaacgatacataccttattatttaacattactattagcgggcaaacttgaacaagggaagctctattatcatcaaaaattaccttatttaacattaaaaacaagacagcaggtcaatattgatggtgaaacatatccgtctggaacttataatcttaaaattgttaagaattcgttaaagattgttttatatcgacaaaaagattgactttcgaatgagtagaggataatattatggttaataaaagggagtagctaacacaatgtgtttacgatttcgtcaatacgatggttttaaatcatccggaacgtaatgaaatagcgagacttttattgcattttaagtatgcaataaagggctcgcttttattgtgttgagaaaaggagaaaatgaatgaaagaatactacaatgaggccaagacggaggtccgcaaaagagtaaatggttcattaaagccactaactaatgaacaagttaaagctaaccaagaaaagtatggtttaaatgagttaattgaaactaaaggaaagagtatacctgtaattttcttagaacaatttaaagattttttagtaattattctaatttttgcagctattatttctggagtattaggtgatatcgaaagtacgctggttattttaatcgttattacgattaatgctattttgggaactgttcaaacagtcaaagcagaacaatcattaaatagtttaaaagaattatcttcaccaagtgctaaagtcttacgagatggaaaagttattgaaattcccagtaaagaagtaacgatcggtgatgaggtttatttagaagccggtgattttattcctgcagatggacgtattttagaaaatgctagtatgaaggtggatgaaagtgctttgactggtgaaagtgttgccgttgaaaaaagctctgatctaatcactggagaagttgctttaggtgatcgcacaaatatggtttattccgggagttttgttacctatggacgtggtaattttttagtaacaggaattggaatggaaactgaagtaggaaaaattgcacaattattgaaatctacttctgaaaagaagacaccacttcaagttaatctggataattttggaaaaaaactatcaattataataatggttttctgtgcattgttatttggtattaatatccttcaaggtggtaatgttggagatgcctttatgtttgctgtcgcactagctgttgctgcaattcctgaggcattaagttcaattgtaacaatcgttttatcttttggaactcaaaagatggctcgagaaggagcaattattcgtaaattacaagcagttgagggattgggcagtgtttctattatctgctctgataaaactggaacattgacccaaaacaagatgactgttgaagattactatattgaaggaaaacgaattgatgctagtgagattgatccaagtattcctttgcataaagatttgatgcgtttaagtatcttatgtaatgattcatcaaatgttgatggtcaagaaatcggagatccaacagaaacggcattaattaatttaagcgctcatttaggagtaccagcaagtcgtgttcgggcagtatatccacgtttaagtgaaattccttttgacagtgatcgaaaaatgatgtcaacccttcatttattaaaagatgggtacacgatgattacaaaaggggcagttgatgttttgatcgaacggattaaatatattcgtaaaaataatcaaatcgtaccaataacggcacaagatagagaagatattttagcgatgaatatggaattctcacaaaatggattacgtgttctagcgataacttataaaaaattaactgctgaaaaaagtttagattatgatgatgaaaatgatttgattttcttaggtctgatttcgatgatggatcccccacgagttgaaagtgcaccagcagtaacagaatgtctccaagcgggaatcactccaattatgattaccggagatcacaagattactgcagctgcgattgcgaaaagaattggaatcttaacagatatttcacaagctgttgaaggtagtgaaattgatggtttaagtgatgaagaactaaaaacatatgttgaagataagcgagtttatgcgcgagtttcaccggaacataaaataaggatcgttcgtgcttggcaagaaaagggtaatattgtagcgatgacaggtgatggtgttaacgatgcaccagctttaaagcaagcagatattggagtggcaatgggaattaccggaagtgaagtttctaaagatgcagctgcaatggtcttaactgacgataattttgcaacaatcattaaagcggttgaaaatgggcgaaatgtttatgctaatatcaaagatgcaattcagtttttattatcaggtaactttggtggaatattagcagttttgtatgcttcgataatggctctgccagtaccgtttgctccagtacacttgttatttattaacttattgactgatagtttgccagcgattgcactagggctagaacctcataatgcaggtgttatgaaagaaaaaccacggccaatgaatgaatctattttaacaaaaccatttttagcaagtgttggaattgaaggttttgttattgctgtaatgacgatggttggatttatgatcggttatcaagaaagtgcattacttgctagtacaatggcatttggaacattatgtctttcaagactagtccatggttataactgtaaatctaaatcaccagtattatttaaaaaatcattttttaataataaatatttgcaaggtgcatttttagtcggctttattttaattacacttgttttaacaatgccgcttttacaatcaatgtttaaagttcaaacattaaatattgaacaattaatgatagtatatggtcttgctttagcaaatttaccagttattcaatttattaaatatcttagaaatcgctaaagttatataaataatgcgttggatatattgactaagtagttataaggatagaaaataagtaaattttctatcctttttcttttttcaaagacttatttatactataatagaactaaatgaggtgaagtaaagtggaagtagctttaaaaacagattcacgagcagttaaaccaggtgatacatttattgccatcccaaacgtagcgcgtgatggacatgattatattgaacaagcaattgccaacggtgcgacaaaaattattgcagaacatggaagttacaaggttgaaacaataatcgtagaaagcactcgtgaatatttaaaaacatatttatatgaaaattattatccattgattaaagatataaaattaattggattaacaggaactaacggtaaaacgacaacctgtttaatgacctatcagattttaaaaatgttgaaaaagaatgttgcttatatgggaacaatcggattttattatggtgatgtgaaaaagccgatggtaaatactactcctgatgtcgatgtgctttataatatgttattagaagctaaggaaaatggtgtagagtattttgtcatggaagtaagttctcatgcccttgataaagatcggattcatggtttagaatttgatgaggtggcttttacaaatttaactcaagatcatctggactatcataaaacattagaaaattatgctaatgctaaaaggattctatttactaagactagaaatgataagattgctattattaatggtgatgatgaacattaccagcattttgttttagaatcaaacaataatatcattattggtcaacatgatagtgatgttaaaattttagaaatgagcttttcacatttaggaacaatatttaaatttgaatatttaaatcatgaatatcaagctagattaaatatggtggggcgatataatatttataattatttaattgctctattattagtaaacaagttaggtgtaaaaatcgaagatatacttgctttaaacgataaattaaaggcaccagcaggaagaatggaattgcttaaatatggaacaaatagtatttttgttgattatgctcatactcccgatgcggtgatcaatgtattaaaaagtgctgaagagtttaaaaatggtcgtattattaccattattggttgtggtggtgatcgtgatgcaactaaacgtccaattatgggaaaagcagcgttagaacatagtgattatgtaatttttacaagtgataatccgcgcagtgaagatcctcaaatgatcttagatgatattactaatggactttctggaagtaattttgaaatagaagttgatcgccaaaaggcaattattaaagggatgcaacaattaaagcataatgatattttaatgattcttggaaaaggacatgaggattatcagattactaaaacagggaaacatcattttagtgatcaagaagaagtgatgaaatatataactaaacaggggacgctttaagcgtcctttatctcataaggaggttaaaatgaaacagatagaaatgcaagatttgactattcctccaattgctattggcacttgggcttggggaaaaggaccatttgggagtaaatttatttttggtgttagtcatggaattgaagaattaaagcccatatatcattatgcagtaaaaaatgggctaacgctttttgatacagcgcctgtttatagtttagggtcatctgaaaaaataattggggatctatctaacggtgaagatattcttatttcaactaagtttatgccgacatcttggctgccgcgtaaatcaatgtcttggacacttaattctagtctgagtcgattgaaaagagcagatactgatatttattggattcatcgacctgccaatgtaactaaatgggctaaagaaattattccattaatgaaggctaataaaattcgatattgtggaatctcaaatcataatttgaaacaaatcaaagaagtagagctaattttaaagaatgcaggtcttaaattagcggcaattcaaaatcattttagtttattatatcgtaacagtgaagaaaatgggattatgaaatattgtgaagaacaaggaattactttttttgcttacatggttttagaacaaggggcattaactggatattacaattataatcatccctttcctaaacggacaagacgtgccagggcttttagtaagcaacgtttaaaacagattgaaccattgattctagaaatgaaaaatattggattaaaatataatgtcggtgttgctgaaattgctattgcttatgctctggcaaaaaatactgttccaattattggggtaacgaaagttaagcatattgatagtgctttggctgctttaaaaataactatgagtgaagaagacattcataaactagaatattttagtaataattttcaattaaaaatcaaaggattttgggagaagaaaatgtaatgatagtggtacgagtaatgacaattaaagattacgacgatgtgtatgagctttggatgaataccaaaggaatgggaatgagaaatcttgatgatagtcgtagtggaattgctaaatttcttgaacgcaatccgacaacaaactttattgcgagtgatggtaataaaattgttggggtgatccttgctggtaatgatgggcgccgtgcttatatttatcatacaactgtgcgaagtgattatcgtggtcagggaattgcgacgcagctagtaaaagaatgtttgtcagcggttaaagctgagggaattaataagactgctttagttgtttttgcggacaatcagctaggtaatgatttttggcagagtcaaggatttaaggagcgtgaggacttaacttatcgtgattttagtttaaatgaggagaatatttgatgaggatccagcaggtagatataacagaggttttttttcaaacaaaggattatactcaaggaatgtatgattcgattgttcgaattggactgtcatttccggtaaaagtaagtttagaacaagggaaattttattgtcaagatggtcataaacggttaagtgcaattgcaagtatggaaaaattagaagtatataaaaaacgtcgaaaaataaatattattgttattaataatggtaatagtcgttctaatgattgctggagaggcagaaatatgcattaattaggattaaatatggaaaattgggaataatattgatgatcaagaattattgtattagttgctttttaaaacgcttaatgataaaataagtatatataaaagggagtagttagccattaggtttacgatgccgtcaactcgatattattttatatccgtatcgtaattaaacaacgagacttttattgtatgcaaatacgatatagtctcgttttttgcataatgttttagaaaaaggagagatatttatgtattacaatcgtgagattaaagagttagcccaggaattttcaactgatttaaaaagtggcttaactgaacagcaagtcacagagaatttggcaaaatatggtccaaatgaattagaacagactaaaaaacaatctattatagttcgattctttttgcagttcaaagatgcgttaacgattattttaattattgctgcagttgtcagcattattgttgaaccaactgaatggatcgatagtgcaatcattgtttttgtggtagtagttaatgcaattttaggcttagttcaggaaaataatgcagaaagagcactagaggctttgcaaaaaatggcgagtcctaaagctaaggttattcgtgagggtaatattattacgatcaatgccagtcaagtcgtaccaggggatctgttagtgcttgaagcgggtgactgtattgcaagtgatgggcgattagtggaatgttttaaccttaaagttgatgagagtgcactaactggtgaaagtgttcctgtcgaaaaaatcagctcgattcttgataaagaagagatcccgttagcagaacgaaataatatggtttatgcttcttgtaatgttacatatggacggggaatcgcaattgttaccacgactggtgaagaaaatgaagttggaaagattgcaacgatgattcagcagactaagcgtgaaaatacaccgcttcaagatcaattggatcaaattggaagaacaataggagttatttgtattattatttgtatcgttgtttttggaatggaactgttggaaggtctctcaattcttgaggcttttaaaacatcaattgcattggcagttgcagcaattcctgaagggttggcaactgttgttactgtagttcttgccttgagtgttcagcgaatggttaaaaagaatgcaattgttaaaagtttaccagcagttgaaacattaggcagtacctcaatagtatgctcagataagacggggactttgactcaaaataaaatgacagttgtaaaaacatatctttataatcgcaaaattgaattattagaaacttgtagtgaagagactaatcaattattgaattattttactttgtgtagtgatggtagtatttctactgttgcaggaaaggaagttgcagttggtgatcctacggaaactgctcttgttaaagctagtttagaaaaaggatttaccaaagatggtttagccgaattatatcctcgatttaatgagctggcctttgattctgagcgtaaaatgatgacagtttttgttaaacatgaagataagattatttcgattactaaagggggacctgatgttatttttgcgcgatgcaataatttagacattgatgaggttagcgtagttaatgaaacaatgtcaaatgaagcactgagggttttagctttaggaattagatattgggatgaagaaccacaagaattcaccagtgaaatgattgaaaataatttaacttttattgggatggttggaatgattgatcccccacgtgaagaagctaaacaggcagtggcagaagctaaatcagctggggtcagaacgattatgattaccggtgaccatgttattaccgcaagtgcaattgctcgaagtcttggaattttagaatctggtcaaaaagcaatcatgggaagtgagttggcaaaaatgtcagatcaagaactagctgagcatattgaagagtattctgtttatgcacgagttgcaccagaacataaagtacgaattgttaatgcttggaaatccaaaggtaaagtagtagctatgaccggtgatggagttaatgattcaccagctttgaaagcagcggatattggttgcgcgatgggaataactggaactgatgttgcaaaaggtgctgcaagcatgattttgacagatgataattttgcgacaattattacatcaattcgtgaaggtcgcggtatttttgataatatcaaaaaagatgttcaattcttattatcaagtaatataggtgaagtattgacaatttttggagcttcgttgatctcattgttaacaccacataattttggggtgccattgttaccgatccatttgttatgggtgaatctaattactgatagtttaccagcatttgcattaggaatggaaccaactgaaccaacagtaatgcatcgtaaaccacgccaaaaagatgaaggatttttctcgcatggtttaggttttactattgcttggcaaggattaatgatcggaacgctaacgttgattgcttatgcaataggcaataaccaagatcatacagttgggatgacaatggcttttattactttatgtggttgtcagttagtgcattcttttaatgttaaaagtagtgcttcgattttaaatcgaacactatttaataatccttatttatggggagcattagcagcagggttattgttacaagtgattattttagcaattcctgaattaagtgcgatttttaaattgcaaccattaaacattgttcaatggggaatttgtgtaggactttgtttatcaactactgtgatttgtgaacttgtaaaattttttgatagacgaaaaaataatccatcttaagatggattattttattatcttattaagtagttctactgcttccatagcatctttagaataataatcagcattaatttctttagcataatcagcagtaagaacagcaccacctacaaaaatagggcatatattatcgatttgttttaatagttcgatagtttttgccattgaaactacggtggtagtcattaatgcacttaaaccgattgccttaggatgatgcgtatggaaagcttcaacaacagtttctggtggaacatctttacctaaatcgattaccttatagccatagctctccaatactactttaacaatattttttccaatatcatgaatatctccatgaactgttgccataatgattggtccttttgtagcagcagtatctttaaaagtatctttaattatcccgaaagcaatttttgatgtttcagcagattgaatcaattgaggtaaaaagattatatttttttcatactgtttaccaacggtatctaaagcaggaatgagaatattattaattatttctaaaccaggtgttgttttcaataattcttttgtagcattagtaacttcatcttttaaaccatgaagaacaatatcatttaaagtaaatgttgaagtgtccttttttgttatggtttcttgattggcacgacgttcaatatatactgcagcatcatgatcatagttgtataatacgttaaaagcatcgattgtagccattaattcttgatccattggattaatgattgggagatctagaccagctgacatagccatagctaagaaagttttgtttaataaaggacgatttggcagtccaaaagagacattacttactcctaaaacagtatgaacacctaattctttgaccattgcaactgctttgaccgtttccataacttctttttgctgagcagaaacagttaaaactaaacaatcaataataatattttctttggtaataccataagaagctgccttatttattatttttttagcaatcttatagcggtctttagcaagaggaggaataccattttcatctaacgtcaatccaatgacaaccccgccgtatttttttacgattgggaaaattgcatccatcgtttcatctttaccatttacagaattaatcaagggtttaccattataataacggcaagcttgttcaattgctccaggaacagaactatcaatttgtagtggtaaagaaattacctcttgaagtaacttgatcacatgtttcatagtcgcaacttcattaataccgggaagaccaacattaacgtcaagaacatgggctccagcttgatcttgtttgattgcttctacaactaattcatcatatcgttcttcttttaatgctaattttaatttctttttaccggtagggtttagtcgttccccacaaactacaacatgatgcccaaattcaacagttttcgttccgctagaaacccgagtggctcgttttggggtaattttcttacgaacaggtaaattattttttagtgaagcgataaagtcgggtgttgtaccacaacatccaccgataattgctaccccattttttacgtgttttaagctttcttgaacaaacgtttctttatccatattgtaacaggttttaccttcaacaaggcaaggaaggccagcatttggctggagcagtacagggattgtagctgcggctaagatttggtcaatgatgggggttaattcaattggtcctaatgaacaatttacgcctaaaacatcaacatttaacccttctaagacattgaccatagttaaaggatcacagccagaaagtgttcgcagattactttcatatgtcatggtaacaaatacaggaagatcactattttctttaacagctaaaattccagcttttacttcataaatatcagtcattgtttctaataatacagcatcaactttatctttagcgataataacttgttttttaataatttcatatgcctcatcaaaagttagagtacccattggttcaagaagctgaccaatgggaccaatatctaaaacaatataactatcgttttgacggtcagctgtcttacgagcaatagtcgcattatcaattgcagcattgattatttcttcataagaatatggagcctctgccatttttagaggatttgccccaaaagtattagtcgtaataaaatcagcaccagcatttaaataatttaagtgaattgtttgaattagtttggggtcagtaatatttaaacattctggaatatcaccagctttaagtccagcatcttgaagttgcgtccccatcgcaccatcaaaaaccaaaatatcattttttaatctttcttgtaacatctttgtcctcttttccgatacatacaattttctttattaacacatgaaaagcaatgtttagtcaatttttcatctccaagaccaattagtccgatcattgatttttgcggtagcagcagattactttcttgaacagtcaaaccaatatgtttgctgcaatttaatgcgttagcaagatttttgtttaattcgagtggaacattaccatatcccggacaaaaacggaaggtccgtttaccaaaattttgctttgcttcatattcatcacatttaatttcaatataactactagctaaggcatccatcacagtcattttcgttaaatttatttttgaataataacgtaactgttgatctagctgtaaccccaaagtacaggcaattataacgattctatcgcaactgtcaaataaatcaattaaatcgggatagttaatcgttaagtttaattcttttatagttaagggatgatgagttaaggtgtatatttgatacatgaatttgggtgttacttgttctaattctttaagacattcatttaaaagaatttcagtattagaatctacttgattatctaaatagcccaaatattttaaagcattttctttaatcatttttaaactcagctaaaatattactagttcgttttaaaatttcatgtacagtctccggtttattcattgtataaagatgaattccatctactccattagtgatcaaatcaataatttgatttgtcgcatagttcatcccaacttctttcattgcttgaggattgcttttgaaacgctcaattgaggctgataaattataaggaatattacaaccacttaatttagcaatatttaataacgactttgaatttgttgcaggcattattcctgcaataatcggaacattgattcctctaattcgagcttctctaaccaaacgataataatagttgttatcaaagaaaatttgtgtaattaaatattctgctccagcatcaacctttttctttaaagcgattaaatcttcttccaatgacgctgcttcttggtgtacctcgggataacatgcaccacttaaacaaaaagtatcaggataatttttactaataaaatcatttaattcactagcatatttataatagtgcggagccttcatcggatcgtatcctcttggataatctccacgtaaagctaagacattttcaatattgttagcttttaatgaatctagaacgcgaattaactgttctggtgtcgcatcaatacaacttaaatgtgcaactgcttcaatactatattcgtttttgattttagatgcaatttctaccgtgttttcagttgttgaccccccagccccatatgtaactgaaataaagtcaggtttaagttttgctaattcatcaattgtttgatagattgagcttatatccccatcgtgatttttagggggaaagatttcaaacgacaaagttggtcgccggtgtaataaatcaataattttcatgtgtagtctctccttaaataaattacgttaattataagaaaaacaagaggtctagtcaactaaaaccccttgttactcactttcaatataatagttatcaatgattccttgaacgatatttgttaattgattagacaatgatgataaagccatgatgctaatcaacctttggttatcattatcaatatctaaattaaaattttcaactgttttcaatactaatggttttaattgatcgctttgaaacttttttatttcaataaattgatcataaatattttctaacgattcatcattagcataaacaggagccaaaacttgttttatctcttgaatagtaatcgtgtttttcaagttataaacaagaagcattccaatgatttgctcttttgtatatttctttccttttactggtttaattactccggctttagaataattgttgatcattgttttggtaagtaatttatcatcaacaaagcgtttattgtcttgaagatggtcatcaaacaaagtcataatctgatccatatatagatctaatgatggaatatcttttgtggttaaatcgcttttatttacaactttatcaattatttctgataattctaattgattcataaaatcacctcatggatattttataatatttgagttaatgtttcaagatatggttgacatatcttacaataatgatatcataaatacataatatagttattaaaactacttaaggaggttgagatatgagattttttaaaaaagcgatggatccagttagtagtgaaacgcattttattggtgctgttttatcattggcaacactagttatgatgatgattattgctattattgaagggtcagatcacttaactataattggaattattgtttttggactatcgtcaattgccttgtatagtgccagttgtctttatcactattataacgcgaatgaagataataaaattaagctgattttacgaaaactagatcattcgatgatttatgtactgattgctggtacgtatactcctatttgtttgtcatatttagagtatccgcatagtatttattttttggcagtaatatgggcaattgcttgtgttggtattatcattaaattattttggatgaatgcaccgagatttatttctactattttttatttattaatgggatgggcactgatttttgatttacccgcatttagtaaggttccgcttggttgcttgggattaattgcctgtggtggcattagttatacaattggggcaatcgtctatattgtgaagaagccaaattggtttaaaacatttggttttcacgaattgttccatatatttgtaatgattggctctgcttttcattttttggcagtcatcatttatattttattgtaaaggacaaatttaatttgttctttttttataaagtgacatctagtatttacagtggtagaattagagtgatataacaaggggattaggagcagtaaaagtttaaaataatgatcattattttaaagggaggagaaatgaaatggtgaattgtaggattgaatcaatgtatttatgtgtcaatgatatggatagggcagttagtttttatgaacagttttttgaacaaagagtgacaaaaaaagatgaaatatatagtatttttgatattaatggtttccgtcttggtttatttgcttataaaaaaatgaatgaagaacatatatttggcagtaattgtttacctagtattgagtttcttaataaagaagttttaaaagcaaaaatcagctcttataaattatgttttccattaactccaataggtactaattgggttgtagaaataattgattctgaaggtaatcatattgaattgactgcgccaatagaaatagtaaaagaaagctagatgaataattatttcattgaagcgttaaaagtaattgaaaccagtattgataattgtagtaagatgcaatctgaatttaggattgaaacagctcaagtaacattattaaaaatataattcaaactttagaaattactaaaatgttaataatgaaaagaaatgtcaatgataaatatataaaagaagatttacaagtagctttggcaccaatcacattaatcattatcaagagtagtaagtgacctattaagtttcaggaatacacgttttaaaaacttaatcaaagtcgttaatattgctaaaactgctatcatcaatgaaacagtaattttaagctgagaagtttattaattttttactaaatgagcagtggtgctttttcttgtggttagttttagattattgtataatgtcggtgggtgataaaaataatgaatttaacaaaaaaaaataaaatattatatttagttacattgatattagtagttggtggtgacttgtttacaaaacatttagtatcatcatcaatgttattaggacagtctcatgaaatcataaataatttcttttattttacctatgctcataacactggagttgcctgggggatgtttgctggtaaattagggttatttattgttgttgctattattgcagcagttgtgatgatcgtattttttagaaagacaaaaagtgaggaagtgttgacacgttttggtctagtgttgacttttggaggaatgattggaaacttagttgatcgaatctttttaggatatgtccgagattttatcgatgtaattattttcaattataatttcccaatttttaatattgcagatatggcagttgtgattggagtagcattgataattgttgagattgtttttgaggagtacattcatggaaaaaattaatttaataattgaagaggataataatttacggcttgataaagttattgcgatgcagttacaggagttatcacggacgcagatccaagatatgatcaatcagggattagtgctggttaatcaaaaaaaggaaaaagcaagttataaaacaaaattaaatgatgaaattgaaatcacaattttagataatgtggatttggatatcgaaccggaagatatttctttaaaaattgtttatgaagatgaggatgtaattgtagttgataagccaacaggaatgatcgttcatccatcggctggaataatgcacggaacattggtaaatgcattattatttcattgtaaagatctttcaggaatcaatggtgttaaccggccgggaatcgttcatcgaattgataaggaaacaagtggtctcttgatggtcgctaaaaatgataatgcacatcgtttactatcaaaacaattaaaggatcatactgttgttcgtcgatatgtagcattagtgcatggacttattcctcatgaacatgggaaagtcgatgctccaattgggcgtaatcctaaagatcgtcaaagtatggcagtgacacggacaaacagtaaagaagcagttactaattttacagtattaaagcgctataatgctatgagtttgattgagtgtcgattagaaacagggaggacacatcaaattagagtacatatgagttatattggctatccggtttatggagatcctaaatatgggtatcgtaaggatgattttagtcacggacagtttttacatgcaaaaaaacttggttttattcatccaaccacacaaaaatatatggaatttgaaagcccattacctgattatttccaagctaaattagatgagttacaggaggaattgaaagatgagtaaagtaattaattggacccaatattttatgggagttgctaaattatcagcttttcgttcaaaggatccaaatacccaagtaggtgcttgtattgtaaatgaagcaaataaaattgttggggtggggtataatggtttaccatggggatgtgaagataatgaatttccatgggaagtgcgtgaaggtgatttgtatgagaccaaatatccttatgtcgttcatgctgaattaaatgcaattttaaatagtacaggacaattaaaaggttgtcgtatttatgtttcattatttccttgtcacgagtgtgtaaaggcgattattcaaagtggtattagtgaaattgtttatgaagatgataaatataaagggactgacagcgatcgtgcggctaaaaggatgttagatgcagcaggtgtaaaatatactaaagttgagccttttgtgattgaagttaaataaggttgtcgttttgacaacctttttgtatatttattttaaaaaaatgaataataaaaaaggataaccatgttatcctagatcaaatctttaatgcgtttaaagttagtcatgtttgttttggtaactttattaagcatcttagcgccatatttgttagctacttcaatagcaatggcatcaacgctattactattcccgcgcggtaacttcattttaagacttcgtgacatgttactaaaatattgtaaatatgcatattttgataaaatcattgaacatataattgctaaatatttttcttcgcctttttggacaaaggttagatctttaacaacgatcacttcactttttaaatagttataatacgttttgggagaaacaaactgattgactagtttgtttttaattggcatacttactttttgcattacattagtaacagcttggttataaagttttgccttaatattagctaggttatttccagctttggccattgcattataatgagagttatcaaggattaataagctatatataagacgatctttaatctctttagcaacccgaacaagttctttgttgtccatgtctttagggtcgcgaacaccgatactgactaaccagtcaaaatcgcgctcatctacataacaggcaacaacgcataatggtccaaagaaatctccagatccagtctcgtcacatccaatatgactaatattagtatatttactagcgtcgtttaaggcactgctactgtcggccatactagagtcgctaaaagctacaagtttatcgtaagcatgcatattaataatgttgattctttttgaactattatttctaactacattcatgttcattacttgtcctcctagtcctactaaattagtatatcatatttctaatctttttgacagtacaaatttgttttgatacaatgtatattaaaagaaattgaggtgttttaatgaattttgcactaaattccatggcaatcgacacagttattgtttttattctattgctaatgttgatttttggctattttaaaggttttgtatatcgagtatatgatttgatggcaacagtagtatcgttgcttgcagcactatatgcttcttcaccgctttcagcaatatatcaaatatataaagttgaagggattggggaaattgttggtaagacaataaatcgatttattatatttattattttatttattgctttaaaagttattttattaattattggtaaatttattaaaccaatattaaaaaatataatctatacaattagtatttttgagcatcttgatcatcttttaggagcgttagttagcttaattgaaggaacgatcattatttatttagctttaatttttgtaattacaccaattattccaggaggaaaagagaatgttgagaaaacagttgtagcaagcaaaattttagagcttgtaccttcagttactgaagaaatgaaagcattatcagacgggtttgatgtttttactaatattattaatgatgggataaattatgatagttttgatgcccgaaacgttgctgcgcttgctgcttcattgaacagtgcttataaacatggtttaattaatcaggaagaccttgaatcagcgttaataaaatattatgatgaaatcgatcgggttaatgagcctatttcgttaaatcaagatcaatataatgaggttgttgatgtattatcaaaattagattcagctaaatttgatcaaacaaaaattttaaataagataatagtgagtgaatagaatgaaaaatatatatgatacattagaatttaatcaaattaaaaataaaatcagtacttattgtgttagttcattagggaaaacaaggatagctgagttaatgccgttaaaagatactgatgatttgaagctggaacaaaaatatttagatcaagcaatgaaactgatttttaaatacgggaaaatgccaatcggtcattttattgatattgaaccgttattattaaaaacaacaaaagatggtactttattcggtgaagattttgtccaaattgtttatttgttgaataatgtcaaagaagtacaaagctatttgagcgaaaaagaattggtagacaatgagctgttgcaattatgcaatgcgctagttttacctaaacaattattagctgatattaatcgctgtattgatagtagtggaaatgttttagatggtgctagttcggaattaagacgaattagacgccaaattttatcaattgaatctaatattagaacaaaaattgatcaagtaaaagttgctaataaagattatttaagtcaagaagctatttcttcaagaaataatcatctggttttgcctgtcaaagccggcaataaaaatttaattaaaggaattgtccatgcagtttcatcaagcggacaaacaatgtttattgaacctgatataattgttcaaatgaataatcagctagttcatgctaaagatgatgaacgacgtgaagtaaatcgaatcttaaccgtactttcgaataatgtaaaagaccattatgatgttctacatgaagaccaagaactaatgattgatattgatgttattttcgcaaaggctgcttatggagtcaaaatagatggaatagttccagaagtggctgaagactaccagcattttagcttgattagagcgagacatcctttaattgagccacatgatgttgtagctaatgatatagtgttaaatgcaccaaagagaatgttattgattagtggatcgaatacaggagggaaaacagttgttttaaaaacggctgggttattaagtgtgatggcactgtgtgctatggctttgccttgtactaaagcaacggttccaatgtttgatcaaatttgtgttgatctcggtgatgaacaatcaattgaacaatcattgtcaactttttctagccatatgaaaagattagttgaaataacaaatgaagtaactgaaaaatcattagttttactagatgaaattggttctggaacagatccgcgtgaaggacaaagtattgctgaagcaatcttaagatatttacatcaaatcaatcccttgattgtagcttcaacccattattcaggcttaaaagaatttgctaaaaatgaagattatattttagtagcagcagtagaatttgatcaagaactgatgcagccaacttatcgcttgattgagggcagtgttgggaattcttatgcgatcgaaatttcatcgcgattaggtcttaatcaagaaattgttgatatggcttatcaaatcaaagaagaaagtctgacagatacagataaattattagaaaaactgcaaaatgaactagctcaggttcaaattgaaaaagatcgtttagaagctttaacaaacgaaacagaagttaagatgaataaatatgaacgcttaattagcagttttgaaaaacataaagatgaaatgatggaaaaggcaaaagcggaagctaataaactacttgaggaatcgaagcaggaaattgatttagtggtagaagatttaaaacaacaagctgttttaaaacaacatgttgtcattgatgctaagagaaatcttgatttattaaaacatgaaccaaaaaaagttattaatgaagaagtccatgaatatcaagttggtgacgtagtcaaagtattatcagctaatcgtcagggggaaattctttcaattaataaaaagggaattttaactattaatatgagtggattaaaattaaatgcaaagcccgaggaagttagctttatttctaagaaagtgaagcctaaaaaagttaaatcaaatctaaaatctttgcgaaaaacaacaaatcaaagctatgagttgaatattataggtaaacgttatgaagaagcaatggcaatcgttgacaaatttttagatgatgcaattgttaataattatacaatggttcggattattcatggaatgggaaccggagtattacgaaatggagttcgtaaaatgttagataaaaacaagaatgttgttagctaccgggatggtgggcctaatgaaggaggacttggggcaacccttgtatattttgaataatgaatcgtcagatgattaaagataaactttcgcttttaccgttacagccaggctgttatttaatgaaagataaagataatacagttatatatgttggtaaagcgaaaaaattaaaaaatcgtgtttcttcatattttgttggagcacataattataaaacaacaaagttagttcaagaaattgttgattttgattatattgttacggattcagaaaaagaggcattattattagagataaatttaatcaaagactatagtcctaaatacaatatctcttttatggacaataaatattatccatatatacaattgactaaagaaaagcatccacgtttaaaaattgttcgcaatgctcaagataaaaaacataaacattttggtccgtttcctgatggtacagcggctcgtgaaacatttaaattgttaaatcggctctatccattgagaaaatgtaatcatattcctaaaaaaccatgtttatattattccttgaatcaatgtgttgcaccatgtattcaagaggtcagtgatgaagtttataaggaaatgacatcaagtattacgaagtttattcaaggggatacgaaagaaatcattaatgatttacaaaataaaatgatgagtgccagtgaggtacaaaattatgaattggctaaagaatgccgtgatttaatcactcatattcagcatgtgacaagtaagcaacatgtgcaatttaatgatttagttgatcgtgatattgtaggttattatagtgacaaaggatatttatgcttgcagttattctttatgcgaaatggaaagttattagctcgtgatttaaatctagttcctgcacaggatgactatcaagaacaaattatctcatttttagtacagttttatcaagaaaatactgagcctaaagagttgctggtgccccaagaactagatattgaattattaaaagaaattgtaaattgtaaaattatcaaaccccaaaaaggaaataaagcaaatttagtagcaatggcaaatgaaaatgctaaagaacaactagaaaagaagtttttattgattcaaaaaaatgaagcttctacaattggagcaatcaagcagctgggagaaatattaaatattcaattgcctcgaagaattgaattatttgacaactcaaatatccagggggcttatgcggttgcagggatggtttgttttaaagatggaacaccatcaaaaaaagattatcgtaaatttaagatcaagacagttgaaggaccggatgattatgccagtatgaaagaggtaatttatcggcgttattatcgtgttttaatggaagggctggaaaagccggatttaattatcgtcgatggtggtaaagggcaaattaaagtggcaaaagaagtcattgatgcgttaaatcttaatattatggtctgtggtctggcaaaggatgatagacattcaacttcagtcttgttagatagtagtggtgaagtggtagaaataaatcgaaaaagtgagttatttttcttactgacaagaatgcaggatgaagttcatcgctatgcaatcagtttccataaaaatgttcgttctaaatctttatttcaatctattttagatagtgtagaaggaattggaccaaagcgaagaaaaatgttacttaaagagtttggcagtgtaaaacaactaaaagaagcacaactggaacagttagaacgtgttttaccacatgaggtagcattaaatctatttaatgtattaaaagcagacaccgaaaagtagttttctcatatattagagtatgaggtgaacgtaaagatgaatataatcctgactcctagagaaaaggaaatttttaatcttttaattaagaatcagtcaacgagagatattgctaaaacgttaggaattagtgaaaaaacagttcgtaatcatatttctaatgtgattcaaaaattaggtgtcgattcaaggattcaagcagtttttgaattgattaaatttaaggaattagaactataatctagttccttttattatggttttttaatactagttggtatataatggaacaaggtgatattatgaaattgaaaagatggcatttatatttaattgtaacactttgttttacgattgcttttatttcaataaaccgcaagtatgatcgcttttatcgggttaatggaattaataatgataatcgcgctttaatagagatgtatttagatgatgaagaacaagattacttagtggaaaatgcgattgcagtcgatcagtttattaaatatatagaatttccggagtttaaattacagtattatgaattttataatgcgttaaatagaacaaataaatattcaaactatagtgatttgatcaatgttggtaatcagctggcaagtaaattggaagtttcttttgctagtaatgcactatcaagatgcaatacactaataaaaaatgatttagtcaatgcttatattaatcaagaaggtttttctttcgataatattgattattaccaattgttacggtcactttatgatgagggtgattatacatacattgcagatactaatacttatttatcaattatgaaagagtttgatggtttagaaggtaaaaaattatatgataatgttaaattgctgagtaataattttactaagggttcattagcatcgctctttaatcatgatttgcagcctaatgccaaacgaatttataacccaagtgatttagctttggttgtcaataacgagacatatataggtggttatgaaccgaaaaatcaggttgagatacgaggaatacctcgagtcaaatattctatgtatcttcaagaagatgcaaataatagtttaatggagatgtatcgggcacttaatgatgagggatataatgatatggttttaacagcggcttatatcagctatgatgtggcatctttaggtagtagcggaatcttaccgggctataacgaatatcagcttgggaccactataaatcttcaaaaaagggaaataagtattgctgattttgatcaaactgacatatataagtggttgatcaatcattgccatgaatatggttttatactgcggtatccaagtgataaagttgatgtgacaaatcatgaatatagctctacaacatttaggtatgtaggtaaagaaattgcttctaaattacatgttcaaaatttagctttagaagaatataacgcaaacgaggagtaactatggaaagagcgattggggtatttgattccggtgtaggcggtctaacggtcttgaattctatcaggaccttgctgcctaatgaaaatattatttatattggtgataattatcattgcccttatggtgaaaaaacacgagaacaactatttagttatgcaagtgaaatagttgagtattttattaaagaaaatgtcaaattgattgtcttggcatgtaatactactagtgctacggtcttaaatgaactgcaagctgtttataaggaagtcttgatcattggagtgattgatgcaacagtggaagattttatcagtcgcggagtcgataatactcttgttatagcaacagcagcaacgattaattctcataagtatccagatacgattgattgttatcagactggaattgaggtgtttacgttgccaacacctaagttagttcctttagtggaggctggaatggataaaaaagatatttatgatgtattgcatgagtatttggattcttatgcaggaaagattaaatcaattattttaggttgtacgcactatcccattttagagaatcaaataaaagatattttaccagatattgaatatatttccagcagtgatgctgtttgtaaaaatgttcgagatgttttaattaaaaataatctattaaatcttaataaaaataaatttattaagatttatacaacaggtagagttgatgaatttttaaaatcatcaacaggtttttttgattatacagatttggttgttgaacatattattataaaatagttagtcgtgattttataatccgactaatttttttgatgaaagtatttttattaaataagaaatatataatatttatttggtcttttaagaggatcacttcatattattatattgaggtgattggatgaaaagaaaactacgtaatggtattatcatttgtgcttgtttgatggtatgctttttctgtattaaacaagataataataggaatgaaaaaaagaatactgctacgatgacagcaaattatcaaacagttgtatttagagacgataaaaacacattagttccaattgaagtagattttggtgctgaagttgaagatgatacaaaatatcgtaatatgattgaggtaatgaaatctaatgattacgagtatttaggtttacatcctatcttagattcgaacctgcaagtgaatgccatggcaattaatgataaatcattaacctttgatttaagtgataatttgtatgttaacagtaatcaggaagcacttgacatttttgaaatgttttcttatgttttttgtaacggagatattgaaaaagtaaatttaaaaattgatggtaatgatattagtactttaccgaatagtacagtaccagcaagctgtattacaaatcagttgggtatcaataattttgaagcaagcactaattatatttataaaacaacaccagttgttgtttataatacagagactatcaataacaaagaatattatgttcctgtaactaaacgaattgaaacaaatgaaaatgatattgatacaaaagtatcaatcatgttaaatgaaatggattatgataaaccattatcattagttgatcaatgttcgttacaagatggaacactatcaattcatttagctgctaatattttaaatgataatgaatcgattgataatactttgtataatcgaatcgttaaatcagctagtcatttagaaaatgttaaaaaagtttcattatttgtagataatcaagagatagacccagttcaagatgtaaatggtgaagtagacaaccgaattaaaatgtaatttaactttgaaccttaattgtgtataataatgtcaggtgataaatatgaagaaagtagtagtaatgtccgatagccatggttatcataagatgatcgatgaagtacaacgtttagaacctgatggcgattactatgttcattgtggtgatagtgaagcacgtgaagagcagttaaaaggctggatatgtgttcgtggaaacaacgattggatggctccttttgatgatgaagttgtttttgaagttgaaggagtaagatttttagttactcatgggcatcgttatggatattataaacgtgaagaagcgatggtagatgatttgctgagacatggttgtgatgtattattatcaggacatacccatgttcctcaatgtgatgaggtgacgggtttttatttaattaatcctggttcaaccactttgcctcgtcgtgggagtggaaaatcttattgtactattctagttgaccagggaaaaatagaagttaaatttaaacaaatattttgttaaaaaatgcttgcacatctcttttagatatgctattatatatgagcagtcaagagagagaggtctacgtagctcagctggatagagcacacgccttctaagcgtgcggtcaggggttcgaatcccttcgtggacgccatttgattaaaaatggctctaaaccaatggtttggagcttttttattttatataaaaggaacatttgatgctcatgatgcatataaataaataggagatgagcagatggaaaatttgtattgttatgaacaaaaacttcaatcctatttagatgagtatcactgtattttaaatcaaatgattaataaaatgactagtgttgaattgtcgtgcagcatatcttataattttatggttcaaatgatcccgcatcatcgtgcggcaattttaatgtcatgtaatttattaaaatacactaagaatgaagctttacaaaatattgcttttaacattataaaagaacaaacaagaagtattgagaatatgtggagaattttatgtgattgtcaaaatcagacaaattctcaagaacagttgtatgattatcaaaataggcttgatattatcgtaggaactatgttcacaaaaatggctgagccatcacgcagtaatgacattgatgtaaattttattaatgaaatgattccacatcatgaaggtgctattgcaatggcgaaaacaactttggaatatccaatttgttctgaattaaaaacaattttacaagctattataacgtctcaatcaaatggagtaaggcaattaaaaacagttttagaagatataacttgttaattaatattggctattaaatggaaaggtaactatgatggatttaaattacattcaaactccactaaggaatcaaactattgaagaacaaataaaagatttttatttgcttaataataaagaaagaacatatcagcatgttcttggagtggctatggcagcagaaaaattagctttgcaatatcaagaagatattagagcttgtattgtagcagctttattacatgatattagtgctgttattactccccaagatatgatgaaaattgctaatgaattacaatggcaattagatagtgcagaaaagatatatccatttttattgcatcaaaaaatatctgctttaatagcttatgagtattttcaaattaggaatttatcaattttaaaggcaatcgaatcacatacaacactaagatctaatcctagtaaattagatatgattatttttattgctgataaactagcttgggatcagcctggggaaccaccgtttaaaaagaatattgaaatggcattaaatgattctttagaagcagcttgttatcagtatataaaatatcagtttgaccacgatctattattatttcctcattgttggatcattgaggcataccgatggttagaaaagtcacattgtaaataacatgtggcctttttgtttgcttaaaattttaagggggtttaaactgtaggaagaagggagattattaaatgttaatacgtaaaatagaggaagttgattatcaggacgtgtatcaattagttaaatatgaattaggataccaaaacttggaatttaataaattttgttggcgacttgatcaaatgcttcaagatacaaactatcaaatttatgttgcaattatcgattacagagtagtagggataattggattgatgttaggttggggggtagaaattgaagggaaaattatgagaattattgcgttggcagtagaacatagatatcaagggcaaaaaattggaagttctttaattgcgtatagtgaacaatacgccctgagcaaacaggtaagtgccatcacagtcaatagcggacttgaacgtcgtcgagcacatgaattttataagaaaaatgattattataaaaaaggttatagctttattaagaaatgtgaataagttgtgaataaagtactaattgttcttgaatttcacctttgacaaaggaatacaatattgatgaggttttagaattgcttgatattaaaaataaaaaaactgcttttattagtgaattatcaggcagaccgcatcattacaattgaagatggaatcatcattgatgacattaaaagtaaataaaagcgtaataatagattttagagttaacgttatgagtagagggattcaactaatgacgttactctatttttattaattgaaacaattaataaccttgatataataataaaaaaagatgatttttaaaagaggcaggtgatctttatatggatattaagagtttgctagagttatttagaaaatctcccgaactatttttagatacaagtgggagatctggtgccaaaacctactgctatcaagattattatttaaaaattggaaaaaaacatgaattagaggcagagtatcgggcattaatatattttagtaagtataattacagtcaagcggcgctagaatatagcagtagtgagcgagattatttattaactaagagaatgtcaggtatgtgcagctgtgccccaaaactaatttctaatccagagatattagcagtaactttgggaaagctgttaagaaagttccatgatacaaaatttactgaagctatatctataaatcataatgaagaaatattaaaacgtgtatttttaaattatcaacaagccaacttagatgagcaaatgacacaaggtattggctgcttagaacttgacgaggtgtttagttatattaatgctaaaaaggatattttagttgaagatacagttattcatggtgattattgtttgccaaatattttttagaccaagattatcgtttttgcggttttttggatatgggacgtgcgggagtaggtgatcgccattatgatttgttttggggaagatggtcacttgcttataatctaggtaatgataaatatggtgatttattttatgaagcatatggaaatgaagtaattgatccagagcgtttgaaattaatcgcatatattgcttgtctagatggataaaggtaaataacttggcgttttaaaaataaaaaatgacgaatattcgtcattttaaaataaacctaatagtgcttgcattgataaacaaaccacagtaatagccacccaacagcaaaatcccatgaaaattggtttggcaccgctttttacaagtttaacaatatttgtatttaatccgatagctgccattgccataacaataaaaaatttgctaagatctttaattggtgcggtaatattaccaggcaggttgaagactgttgtaataacagaagctaggataaagaataagataaagaaaggaaaaattttcttgagattaaaagtactttcacttttttcagcatcgcgagtacgtttaaaagctaatactaaggtaattggaataattgctagtgttcttgttaatttaacaatcgttgcttgatctagggtattacttccatgaataccatcccatgcagttgcagtggcggtaacagaggatgtatcattgactgcacttccagcaaaaagtccaaaaccatcatttgataatcctagcataccgcccaaagttgggaaaattaaggcggcaagaatattgaataaaaagattactgatatagcttgagcgatttcttcatcgtcagcttcgataactggtgcggttgcagcgattgcagaaccaccacaaattgatgaaccaaccccgatcagtgttgaaatctttgatggcatttttaatactttgcatagtacataggctacgactagagaagttgcaatcgttgagataattattggtaaagatgaacttcctgtttttacaatatcgcttaaattcataccaaatcctaataatataacggcgtattgtaagatttttttagaagtatatgtgatcccactttgaactttgcttttatctttaactaagaatgtaatgatcattcccattaaaatggcaaatacgggaccgccaatcaatggcagttgtttaccgagatagtatgctggcattgcaatagctagacatagaataactcctaaagcattattttttatttttgacatttctaatccccctttgtcgaagttattatacataaatcaaacaataaataaaaattatatatatttatataacgataataatatgttatagttataatgaggtgatttaatgttagattttcggatcgatacttttttggcggtatgcaaatatatgaattttactaaagcaagtcagtatttaaatattactcagccagctgtttcgggtcatattcgttatttagaggaatattatgatgttaagttatttatgtatattggtaaaaagatgcaattaactaaagcaggaaaaattttgcttgatgtagctacaacattaaagcatgatgatatttttttgaaaaataaattaaataatttgtcattgaaacaagagctggtttttggagcaacacttacagtaggggaatatgtgatgcctaaagtgattgatcaattgttaaatgaaaatcaaaacacaatgattaagatgcaggttgcaaatacaagtgagttattaaagatgatcaatgaaggacaacttgattttgctttagttgaaggatactttaataaattagagtatgattatcgaaaattttgtcaagatgaatatatatgtgttggttcaattgattttccattgtcaatagtccatgatattagtgaattatttaagtataatctaattattcgtgaaaatggctcaggttcacgagaaattattgaacgatggttaaaagagcggaatttagatattgatgattttagtaatattattgaaattggtaatattaatatgatcaaacgtcttgttaaaaataatcatggaataacttttatctataaattagctgttgaaaaagaattagctgaaagaagattgaagcaagtcaaagtaaatgctttaacaataaaacatgatattaattttatctggcgtaaaaatagtgtttttaatgactactacgaagaattatttgaggtgtttcgattgcaaaatgataaagtattgctataattacgtttgtaaggagtgatgattatgcctttgacagatgatgattttttaaaggatagtaagttagaactttataatgaagtgattgaaagtctccaagaacaagaagaaactacagatgtcttggattatgaatttgatttagaagaagaatagtgatgtatcctcgatacatcatttttaaggagaaaatatgattgaagaatatatagctaataatcaatttcaagatgcacttgatctattgaatgatatggatgacgaaatgacgcggtatcagcgtcttgtttgtctttatggtttaggtgaatatcaaatggctaaagctgaaggaatgttagcaaaagcgaaagcaagtaatacctattatgatgttgtaagtatttatgtggctactttaaaggaactagaggagtttgaagaagcaatcaatatcatggtagaagaattatcaatgccatatattccgtatgaatatgaagcaatctttaatgctgctcatgatgaactgctgttagctaaacgtgaagcaaacgagggaatggaacggcataataatgcttttagtttggatgatatggaaaatattttgatgaaagatttgcctaatgaggatttattgtatatggcaattgaacaaatggaaggaattaatattcggcgcctattaccagctattcgtaattttttgaaagatgaaaataagcctagcttcgctaagagtttactcattgaattgatgattgatcaagaaatagatgaagaaatgaccttggtaaaaaaggggattgaatatggaattaatccaagttatgctccattagttttgaatcaagaagttggtggaacgatcttaaatcttttatctgaaggaattgaagatgataatccttcgttatattcattgtgtgagcagtttctaaatttctatctatatttagtttatcctaaatatatcgatgattatgattatcgtccaattgctgcagcaattcattatcatattgcgtcgatgcagtatattgacattgaattagatgatatcgagtacctttataattgtgataaagaagaaattttagaaaaattaaatgaaattaaagaaattgaatattaaagtactgaaattgcaagattaattgttcaaaaaagttgaattaatagtattgttagtatataatacgtgatgaaactaaaaaaggagaatagtatgaaaatcaataataaaaaattagaaaatgcaatcgtagaactaacagtagcatttgatagtgaagaatggaaagctactcaagaaaaagcacttgataaattagctaaaaatgtaaaaatcgatggttttagaccaggtaaagcacctgcagctatggtaagagcaagagtttctaaagctagtgttttagaagaagcaacagatatgattttacaaacaaaatttgttgaaattttaactgaagcaaatgttgaaccagtagcacaacctgctttaagtgttcaaaaagtagatgctgatgaattggaagttcaaatcttagtaccagtaaaaccacaagttgagcttggtgaatataaaggattagaagttaaaaaaggtcgcgttacagtaactaaaaaagaaatcgaagaacaattagcaaactatcaaactcaatttgctgaattaacagtaaaagaaggtgggaaagttgctaaaggtgatactgcagtaattgattttgaaggatttgtagacggtgttgcttttgaaggtggaaaaggtgaaaactatccattagaaatcggtagtggttcatttattccaggatttgaagatcaagtgattggaatgactgtagataaagaacaagatatcgttgttactttcccagaagattatggtgcagctgatttggctggtaaagaagctactttcaaagtgactgtacatgaaatcaaagaaaaacatttaccagaaattgatgatgaattagctaaagatgtaaatattgatggtgttgaaactttagatcaattgaaggatcatatcaaagctaatattaaaactcgtaaagaatctgaaaatgaaaataaattcatggatgatttatataaagcaatcgtagcgtcttctaaagtagaagacagtgatgctttattagaacaagaacaaggattaatgttacaagaaattgaacaaaatttacaaagacaagggttaaattttgaagtttaccaacaatttactggtaaatcaaaagatgatatcaaagaagatattaaacctcaagctgaagaaagagtgaaattaaatgctattcttgcagcaattatcgaagaagaaaaattagcagttagtgatgaagaattagaaacagaattaaaaacaattgctgaatattatcaaaaagaattagacgaagttaagaaaattttcgaaggaaatatgagccgtatcgaaaacgatttgttaactcgtaaagctgttgatttagtaaaagacaacttaaaataatgaaaagacgctcatgcgtctttttagtaaaatagcgaaataggaggaaatagaatgaatgaacaaactgtattaacgttaccggtagtttgtacacggggcatgattgttttcccagaaaacaggttaacattagatgttggtcgtccagtgagtttaaaggcacttgaattaagtgctaatgaacatgataacaatatcatttttgtctcacaaatcaatccattagtggataatccttcttttgatgatgtgttccatattggaactctttgtaaaattgatcgtaaagtgcgccgtgacagttcgggaactatcaaattaactgttttgggggcaaaaagagttaggctgactaactttgaagaacaacaaggaagtatctactcaactgttgaaattattgaagatgaatttggagatcgaaatgaagaagttgctttagttcgtaagacaacttcgtattttgaacaagcaaaacgcagtatgccaaatatgccgctagattcaatcaatcgattaactagtggagtatcagcaagtgttttagctgacacaattggacaatatttaccaattgatcttaatcaaaaacaaaaaatcttagaaactattaatatcaatgaacgtttattattagtagctagttcaattgaatcggaaaaagtgataggtgaaattgaagaaacgattaatcgtaaagttcgtgaaagtattgatgaaaatcaacgtgagtactatttaagagaaaaacttcgggctattaaagaggaattaggtgatagtgtaccgaaggaagacgatgcagaaacgattcgtgaagaacttgaaaaaaatccttatccacagcatgttaaggataaaattgaagaagaattacgccgttttgaaacaatgccagcagcttcttcagaagctaatgtagtaagaacatatattgactggatgatgaaaacaccttggtatcaagaaactaaagatgttgaagatattcaagcaattgaagatgttttaaatgaagatcattatggtcttgaaaaggtaaaggaacgaattgttgaatacttagcggttaaacaaatgactaaatcgctaaaagcaccaattatttgtcttgctggtccaccaggggttgggaaaacttcaatcgctaaaagtattgcccgtgcactacagcgtgaattcatcaaggcatcattaggtggagttaaagatgaagctgaagtacgtggacatcgtcgtacttatcttgggtctatgccaggaagaattattcaagggatgaagaaagcgggagtaataaatccggtcttcttacttgatgaaatcgataagatgtcaagtgactataaaggtgatccgactagtgcaatgcttgaagttttagaccctgaacaaaatagtcaattctctgataattatttggaagaaccatatgatttatcaaaagtattgtttatcgctactgcaaatgatctaggaaatattccagctccgcttagagatcgtttggaaatcattgaactatcttcatatacagaacaagaaaaactaatgatcgctaaaaatcatttaattaaaaagcagttagctttacacggtttaaaggaagatcaactagtaattgaagatgatgcaattatggcgattattcgtcactatacgcgcgaagctggagttcgtgatcttgagagattgctggcaaagatttgtcgtaaagcggtattaatcgttttaaaagaaaaacgtgataacttaacagttaataaagaaagtttagaaaaacatttaggtaaagcaccatttgaacatactaagaaattagctcatagccaaataggtgtcgttactggtatggcatatacacaatttggtggagatattttaccaattgaagtcaatcatttccaaggatctggtaaatttattattactggtcaattaggggatgtaatgaaagaatcagcatcgattgcattagactatatgaaagctaataaagagaaatatggtcttgaaaaaattgcatttgataaagaagatattcatattcatgtgcctgaaggagctgtaaagaaagatggccctagtgcaggtgttaccttgaccactgctatctactcagcttttaaaaatcagccggttcgcaatgatattgctatgacgggtgaaattacattacggggaaatgtgctgccaattggtggtttaaaagaaaaatcaatttcagcgcatcgttctggaattaaaaagattattatcccaaaggataatgctaaagatattgatgatataccaaaatctgttcaagatgaattagaaatcgtattagctgatcatattgatacagtactagatcacgcacttgaaaaatagggttaaaaataaccctttttttcttattgtgtggtacaatgaaaaaggtgatgagaatggtaaaaataaagaaagcagaatatgttttatccgcagcatggaaaagtcaatggccagaagaaagttttcctgaaatgtgtttggcgggacgtagtaatgttggtaaaagcagttttattaacgcaatgttaaatcataatggtttagctaaagtttcagggactccaggaaagacaagaacattaaatttttttaatgtcaatgatgcattatattttgttgatgttcctggttatggttatgctaaagttaatgatagtattactaagcaatttggtaagacaatggatgaatacataactttacgttcaactttaagaggatttattttattagttgattatcgtcataaaccgactaaagatgatgtgctgatgtatgaatttgttaaacatcatgatgttccggtaatggtcgtggcaaccaaagaagataaattaaaaagaaatgatctgaaaaagaatgaaaaaattatcaaagatactttggggtttcatcctgaagataaatttgttcgtttttcaagcttaaggaaaaaaggaattgaagaagcatggaactttatctatgagctatgcgatattaattttaattagattttaaaaagtaaaatgatggtagatgcaagaaagatagagcttttaaatgtatctacttttattttgtttaaataatatcaaagtatctagattctggtggaacaaagtagaatgaattagtatattctataaaaggcggtcttttttcatatttttaagaatcgtgcatatagtttgatgggaggtatatatgcaaaagatatattttgaaaaatggattgatttaaatcatcaattgaatgaattattatcattatcagtagatgagtctattaattacaagattgaaagtgtaggcgttcgagcagtaggaagtttaattgttaaaggagagtataatggcaatcataaatttgatgaaaatattgaattagatgtattggcaacatttgataagattgttgatcagcgagatttcaatattaaagttgaagattttgattattttattaaagatggaaatatccaaattaagattgaagtaggtattcatggggtggtagaaggagaagatcgatatgtacgggatgagcatcttgggcatgatgaagcacttgaagaaattgaaaacttaatcaaggatactgaaccagctaatgcttcaattgagcaattagttcgagctaaacctgtcgaagtccaagaaactgggccagtaactccagcttacgttgctcaagcaaagcagccagaaagtaagccgatggctgctgaaactacgacttcaacagtaaaagagataaaagcagtggcaaaagaaatggataatcatcctaaaaacttagaaacatcaaaagttgctgtaatgccgcagaaatcagagtcatcagtacacgcagcaaaagaaccggctgttcatatgaccaaagaaccaatggcacatgttgctaaagaagctgctgtaatggaagtcagtaaaaaagaaacagctatggctgaggagattagtgaacaacttcaagaaaaggtttaccaaagcaagtcacgaccaatttttcaagacactagcgatagtgtgggaacttattacttatatatagttaaagaaaatgatagttatagtgaagtggcgacccgttatagtgtggatgaagaaataatccgcaattataaccaagataaggctctagaagccggcagtgtcttaatcattccatatgttccatgaacgaattaattaaggaagcctattcactagaagttattggttatattaaagtaacaaaaaaagtctataaagtaaaatgtcgtgaaggattcttttgtttaaagtttgttgaagacaatggattgactgttgttattgatcatatagagagcttgcatttaaaatgctttttgccagtaatcagaaattataaaaaacaagttctaacaagttatgaggataaaactttttatttaagtccttggttagcaagtgataatgcaatcgttaaagaattaaaattaaaattttattatgaatgcttatcatatttgcattcaacttctttttttaattatagtgtttcaaagagtttttttaaacgtcaaattgaagatatagcaaatattattcatgagcgtcaagcttattacaatgaaattatgagtaattttgaagttttatcgtatcgtagtccaacaggatggatgtttgttttaaattatcatcgaattgaaggttgtctaaaaaaagccttagaacttttggaatgctatgaacaatatgtttgcaatctagatacgataagattatgtctgacatataataattttaattatagtcatgtaatgatgaaagaaagtaaattaatttctattgatcaaattaaaatcaacttatgtatttatgatatttataatatgtatcaaagaattccagagtttatctttgattttgacgttattcttgatagttatttttgtaagataaagctcttaaaagaagagcggcttttattacagtgtttgttacatgttgttccgatcattgaattaggacatgatgaaattaataatattatcatgatgtctcgcttattatattatttggattcaatttcttcgttaaataaaaagttagcgattgactaggactgatgattttgttagaatatttctagcaatgattaggaggagtagatccagaaacttttaagagagtccctggctggtggaaggggataagataatggattgaaggtagcctaggagcatgtctattgaaaaaagtaggtagacacgtatgactgcgttaaggtcttgaggcatagataagctatgcaaagtaaggtggtaccacgagcattcgtccttatgacggtgcttttttattttaaggaggaaattatgagttattcagtggtttggattttatttttaggtggatgtttatttttaatgtatttttatagtggtaaaatgcgtcaagttaaaaaatatcaaaaacaacagcgggctgcatatgaagaaaaccgggttaagtatagtcattttacaagcgaagtgtttgatcaaactcctgatgaagagttaacacatgctgttttattccaccttttagcaaaagaagataaattgtatgaaggagaagaaattactggaacattgattgatgtaatgacaccaagcgaattactgatctacactatttatcaagtagaactttcaatggaaggagggcgtggttcattgcactcattctttattaaggaaccatattgcctttatcgtccatatgccattaaagcatttgaggctgtggattgccatgaaattgctgagttgatgactgcagcagaaaaattagctgtaatgattgaaaatgaggaagaaattgaattagatgaagatagtgattatggaaaatataatttttctgattttacaagctcattattgtcaatgttgaaatcttctggaattgttaataaagcagctaaatttattcgtgaaaacaaaaatgattttattgatttggaggtaacaactgatgagcaaacaactggaaccgaagtataatcatcataaagtagaagaaggaaaatatcgtcattggatcgataaaaaatattttgaagctggtgatactagcaaaaagccgtattcaattgttattcccccacctaatgtaactggtaaattacacttaggtcatgcttgggatacaactttacaagatatgatcatccgttataaaagaatgcaaggttatgatgctttgtggctgccgggaatggatcatgcgggtattgcaactcaagctaaggtagaggcaaggatgcgtgaagaaggtatttctcgttatgatcttggtcgtgatggctttttagaaaaagcatggtcatggaaggaagaatatgcttcaattattcgagctcaatgggaaaaattaggtttatcattagattattctaaagaacgttttactttagatgatggtttaagcgaagcagttaaagaagtatttgttaaattatataatgaaggattgatttaccaagggaaacggatcattaattgggacccagttcaaagaacggcattaagtaacattgaagtgattcataaagaaattgaaggggcgatgtattattttaaatatcaaatcgttgatagtgatgaacaattaattattgcgacaacacgtcctgaaacaatgtttgccgatcaagctatatttgtgcaccctgatgatgaacgttatactcacctagtcgggaaaaaagcaatcaatccagctaatggtgaagcgttaccaatcatggctgatagctatattgatatgtcatttgggacagcggtaatgaaatgtacccctgctcatgaccctaatgactttgcgttagcaaaaaaatataacttagaaatgccaatttgtatgaatgatgacggaactatgaatgaactggcacataaatatgcaggaatggatcgttttgcttgtcgagaggctttggttgctgattttaaagcagctggggttgttgaccatattgaaaaacatatgcatcaggtggggcattcagaaagaagtaatgcaatcgttgaaccatatttatcaaaacaatggtttgttaaaatggagccattagctaaggcagctttagaaaatcagttaaaggattctaaagtaaattttgtccctgaacgttttgaaaaaacatttaatcagtggatggaaaatattgaagactggtgtatatctcgtcaattatggtggggacatcaagtaccggcttggtatcataaagaaaccggtgaagtttatgttgggaaaaatccacctgctgatttagaaaactggaaacaagacgaagatgtcctagatacatggttttcaagtgcactatggccattttcaacacttggatggcctaataccgatagtgaattatttaagcgttattttcctaccaatactttagttacagggtatgatattattttcttctgggtgagcagaatgattttccaatcattacacttcactgaggaaagaccattcgaacatgttttaattcatggtttgattcgtgatgaacaagggagaaagatgtcaaaatcgttaggcaatggtgttgatccgatggatgttattgatgaatatggtgctgatacattacgcttcttcttaacaactaattcggcaccaggaatggatttgcgttatattccggaaaaattagaagcatcatggaactttatcaataaaatttggaatagtgctcgttttgttttaatgaatattgatgatgaaatgaaatttgaagaattatcatttgataatctaaatctttgtgataaatggattttaaatcgtttaaatgaagtgattcgtgaagtagatattaacatggataaatttgaatttgttaatgttggtagtgagttatataaatttatttgggatgacttctgttcatggtatattgaacttacaaaagtacatttaaatagtactaatgatacagaaaaacaggcaagtttaaatacattagtttatgttttaaatgcgattgttaaaatgctgcatccattcatgccatttgtaactgaagaaatcttccaggcaattccacatttagaagaatctatttgtattgctatctggccagaagtaaatgatcattttactgatgaaagtattaatgaccaatttacatatttaatcgatattgtaaaaggtatccgtgaaatcagaacacaatatacgattaaaaatgcaattgaagtgccatacgtgatcaatactaaaaacgatgatctagaaggattgttaaataaatgtttaccttacatcaagaaattatgtaatgcagtttgttcaggttataatcttaatgctgctggtgaggttgcaaatattacaattaaaggtggcaattcattattagttgaattaggggattatattgataaagatgctgaaaaagaaaaattagctaatcaacttaaaaagttagaaggagaaattaaacgttgtcaaaatatgttggcaaatgagaagttcacttcaaaagctccaaaagaaaaagttgaactagaaagaaataaattagcggattatcaatctaagtatgatgctgtaaaagaaaaattagagcaaatgtaaaaagatgaagaaattcatcttttttctatttttaaaagtaaaaattattttcttgcagtaaataataatataaggtttagtggtgagtgtgaccttaaattcaaaagaggaggcaagaaaaatgaatgaattacagcaatgtatgcaaatggaagtaatgggcggtggtgttacgggatttttcttttgtgttgtaattggaactgcaatttataagatgtttcgttcgggggctggacgcgtatcgattcctaaaattatttcaatcgagtggcgttaaaatgaaagaattatcgattacatctcagcaaaagatcaatggtggcggagcgattgtttatgtgatttctttagtagctgtagctgctggttatagcgttgctaaattattaagaaaacgtttttcaattacacgttaattgagcatatttataaactgctaacatatactagatttggaggtgcaagatgaaaatagtaagacttgtagtagtgttagcagttgctttatcaatttgtttttgtggaatctatttgaagtttttttcaacgatcaatagttatattaatacttacatagttcaagtaggaatatataaacaagatgaaaacgctaatgaaatgataaaaaagttatcagatttagggaaaccgaattataagtatcaaaaagataataatttcgtagtgataacaggtgtgtttttggatgaaaaggaggcaaaggacatggggaatacaattagtgaaagtggaatcacatgtgtaataaaacaaacgaaattcgaaagtagttttaaagaggttattgaaaaacaagattatgaagcaattattaaagaattaggatcatgaaattaaaaaactatccattggaagaacgaccgcgcgaaaaagccttccatcacggaattgaaagcctaaataatattgaattattagcattagtcttaagaactggaaataagcaagaatcagcgattgaattggctcaacgtgttataaatgaaattgggggttttcgttatttgcatgatatcaattattatcagttgattcagattaaaggaatcaaacaagctaaagcaatagaagttttagctattattgaaattgctaaacgtttggataaacagcctgtggctatgtcagctattaaagaaccgcgtgatggttatgaattgttgaaaaatcaattaatgtttgaacagcaggaaaaagtgattgtattatgtttaaattcacgcttagaggtaattaaagaaaaaaccgtatttattggtgggaataacatatctattattagtgggagagagctgtttaaagaagcattgatctgtggtagtaatcgtgtgatggtcgttcataatcatccttcaggtaatcctgaaccatcaattgaagatattgaagcaaccgagcgcctatatagtatggcaaaagaattagatatagatgtagttgaccatttaattattggtcgtagtagattttatagttttgcttcaaataagattattgaagtttaaagataattgattattttatattaatgccttataatgatatggatgtgaggtggtaatttgaataatcgtaaaaaacaaagaaataagagaatagttttaattataacggtagcaattgttgttttttctactatatcattggtattttcaagaacccaagggggacttgagcgaatggtcagcgattcgattgctgcaatagagtattatgtagtaaaaaaaccagttgaatttgtaagtaatttatttagtgaatataatgagttaaaagatgtttataaagaaaataagattttaaaagcaaaattatcatcttatgccagtgtcgaagttaatactgatgttctttcaaaagagattgatgagttgaaaaagatgctaaatattgaatatttgccaactgattataatgttaagacaacatcatttgttcgtgaaagtgatgattggaataacgaaattacaattgatttaggaagtttggctggagttagcaaagatatggtcgtaatttcttcaaaaggaatgattggtaaggttacttcggttacagaagtgacggcgcgagttcagttattaacagcagagaatcctacttctgcattaccgattcaagttattaatggtgatcaaaatgtttatggacttttaaatcgttatgacattgagtcaaaatgttttgaaattactctatttagtgatgttgaaaaatttgaagataatgccaaagtaataacttctggcttaggtgggaaagcgcctaaaggaatttatattggaactgtagaaagttctattgtttctgaagatggaacatcaaaaacaattagagttaagccggcagcagattttaatgatctgtcatatgttgcggtagtgtttaggagcgatagtaatgaataagcaattatatcgttattatctagtgatggcattaagttttgttgttgatagcattattagttattatttaccgtataattttgataaattaggaataacaattgttccttgtgttagtttgatgatgttcacattgctgaataatacaattggtgatgaacaccgatacatatttgcaactgtgactggactttattatgcgattgtctacgcaaatagtttactgatttatgtgttgctttattgtgtttatgctttttttggaaagaaatatactaaattagcaacttatacccttttagagatgtttatcgccgtaattgtgacaataatcgcccaagaagttgtgatatattggttagtgtggataacaaatgttacgcagctatcaatcgtagctttcttgacaaatcgtcttttaccgacgttaggagctaatttattattgattgcaccagtatattttatccacaagaaattaggattcgagggtaaagtcaatgcatatcaaagtaaaaggagttaataatcatctagtttttgttttagatgataatcaagattttaatagtttaatgaatgaattggaaagtctcttggaatcaccattgcttaaaagtgatggctattatccgagggctttttttgattttaaaagtcgaattttaagtattcatgaattattaagattattggatttattatttagtaagcaggtattattgtttgatggaatcaatatggccaaagtagagaagaaaaataagattaaagtaatcaacaaaactgttcatgctggagaaattttagaattggatcaagatgctttgattattggtcaagttaatcccggagctattgttagatttaaaggaaagttgtatgtaatggggcgcgtcagtggattggttgagggattaaatgctcgagcaaaaattagtggacaattctttaaaaatgcccatgttagaattaatggggtatctcgacgaaattatacaagttatgaacttacgatgctttattataaggacaacgaaatattcttagataagggggatatgatatatgtctagagttattgtagttacttccggaaaaggtggggtaggtaaaagtagtgttagcgttaatctggctagtgccttagctttttcaaaatttaaagtatgtttaattgatggtgattttggattgaagaatttggatgtgatgatggggttagaaaatcgtgtagtttatgatttaaatgacgtcgttgaaggccgctgtacaattgaacaagtattagttaaggataagcgtatagatggattgagcttattaccgtcatgtaaatctttatcatttgaaaatctagatacagaaataatgaattcattaattgaacgattaaataaagattatgattttattattgtggacagtccagctggagtcgaaaaaggttttcaatattctgcttcattagctaatgaagcaattgttgttgtcaatttagatgtatcatcattacgtgatgccgatcgcgttgttggtttattgatgaaaaagggaattaatactattaatatgatcattaataaagttaatgttgatgatattgaaggagctcgctcattaacggtggaagatgctcaagagattttatcattaccgctgctagggattgtttacgatagccatgatatgattgaagctaataatcgtggtgtgccgattttcttaaataatcaacatttattacatagctgttttgttaatatttcaaagcgcatactcgggcagcaagtaccttatgctaaatataaaaagaaaagtttaattcgtcgatttttttattcataattaacgtctttaatatcatcagattcatataatggaataggtgatagaatgagtgatctagatgatgtaagaaaaagaatgcaaaagcgccggggcactaataaaaagccattaaatgatgataattttaagcgattctataattttatggtaaagtttatggtcgtaattttagtggttttagtatcaatgtcatatattaaaatcaatccggattctaatattaagaaaatgattttgaatgatactaattataaagcggtaacaagctggatatctgataatttattttcttttttgccaagtgatgatgttagtgtttctagtggcgtggagtatcagcatgttaaagatgactattataaaaataatagtaatgaggtattaagtattgaagctgggcgcgtaattgcaactggtaatgatgaaaacttgagcggatatgtagtaattctaggcaagaatgatgtagaaattacttatagtaatattgataatgtaatggtgacattgtatgacgaggtagatcaagggatggttttaggcagttatcaagatcagtttgttttacagtttgaacatttaggtaaggaaattagttatgaagagtatcaaaggatggagtgattggtatatccatccttttactttgatttatctaatcgctgcttggttaaatgacaatttatttgcttatttgagtgctttgtttattgtctgtactcatgaatttggacactattattttgctaaaaaatttaattttgaaattgagaaagttgagattttcccttttggagcttttttgagtttaaatgattatgggactcatcatattattgaagaactggtaatagtcatggcgggtctatctactcatttgggaatgtttatagtaataaaagtattttttgatagcgaatatttattggcagttaaccaattagtatttgtttttaatctcttaccgatttatcctcttgatggatcaaaaatattattactagttttttcattatttaaagattattatcgagcagtcaagttacaaattaaagtttcaattttttctttatcagttttgattgtattatataatcaaatgggatatatcttagtttatttttatttgctctatataaattatcaatatattaaagagttccgttatataattatcagattatatttgaaaaggatgcatgataatcaatatcatcggcttaaaattaatcatgactaccgtttttaccgcccatatgaaaattattatttgattggtgggaatggttatagtgaaaaagaagtacttcaatatttaataaaaaacttaaaaagtaattgactttgatgggtaaaaataatataatgcatatgttgtagacctctagctacaaccgcacataaaaggtattaaagcaatgctgccttggttggcgagtcttagaatattataggaggtgcgatatgtacgcaattattgaaacaggtggaaaacaattaaaagttgaagccggagatactatctttgtagaaaaattagatgttgaagcaggagaaaaagttgtttttgataaagtattagctgtaggcgataaaacaatgaaattaggtgctccttatgtaaaaggtgctactgttgaagctactgttgaaaaacaaggtaaagaaaagaaagttgttatttataaatataacgctaaaaaacattaccacaaaaaacaaggtcatagacaaccttatacaaaattagtaatcaatacaattaataaaactgctaaaaaagctgctgaagaaactgcagaagcttaatcaaatgattaaggttttagtaaaacaaaataataatcaaattgttaatcttagtattacaggtcacgctgacagtggagaatatggtaaagatttagtttgtgctggtgtttctactgttggtattggagcaatgaatatgcttgcaaaaaaaggattcttagctaaaggcttaggaacgattgagattaatgaaggatatataaatgtagttgtcaatcatactgatgaagtttgtcaagtggtgctagagacacttgttgtaactttagaaacgatggttgaaagctatggtcgatttattaagatatctaaagtggaggtgtaacatatgatgttcaaattagatttacaattattcgcttctaaaaaaggggtagggtcaactaaaaatggtcgtgattctaaatcaaaaagattaggagctaaattatctgacgggcaattttgtactgcagggtctattatttatagacaaagaggaactaaagttcatccaggtactaatgtaggaaaaggtggagatgacactttatttgctacagttgatggagttgtaaaattcgaaagacttggtagagatagaaaacaagtttctgtttacccagctgcataattaaaatccctgcaaagggattttttcttgtactaataactgattatttgtatcataataataaagagatgaaaagaggtggatatatgcagtttattgataaagcaaaaattagagttgaagctggaaaaggcggtgacgggacagtagcttttagacgtgaggcccatgtaccaaaaggtggtccagctggaggtgatggcggtcgtggtggaagtgtgatttttcaagcgacgacctcattatcaactttgttagatttgaaatataatcgattatataaggcaccatctggtcaaaatgggatggctaaaaaaatgcatggtaaagatgctattgatacggtcattaaagtaccggttggaacaatgattcttaatgaagaaactgggcagatcatggcggatttaaccgaagataagcaacgtgttgtaattgctaaaggtggccgtggtggtcgcggaaatgcgcgttttgcaacttcacggaatcctgcaccacaaatttgtgagcgtggtgaacctggtgaaaatttcgatcttatttgtgaattgaaattattggcggatgtgggattggttggttttccatcagtaggtaaatcaacactcttatcagttgtttcacgagcacgcccggaaattgcagattatcattttactacgatcgttcctaatttaggagtggttcaagtaaaagatggacgtagttttgttatggctgatttaccaggattgattgagggagcggctcaaggtaaaggtttggggcatcaattcttgcgccatattgaacgttgtcgagtaatcgttcatattgttgatatgggagcagtcgatggccgtgatccatatgaggattatgttactattaataaagaacttggtgaatatcaatatcgtttattagaacgtcctcaaatcgttgtagcaaataaaatggatgaagatggggctgaagaaaatttagttcgttttaaaaaacaggttggtgaagatgttaagattttcccaattagtgctattattcatgatggtgtagatcaggttttatatgcggttgctgatgcgttagctactgcaccaactttcacaatggaagatgaagttgaacatactgttctttatacaatgggtgatgaggaagataaaccatttgaattacataatttaggtaatggtaattggcaaattactggcaagaagatcgagagaatggtggcaatgacatcgttagtaagtgatgattcattaaaacgactattgattaaaatgcgtaatatgggtgttgatgatgcacttagaaatgccggagctcaagatggtgataatgttgctatcggtgagtttgaatttgatttttatgagtaaccagctagtaatactagttggtttttttcttttacaatgctataattgttgagaatggtttgaaacgattttgagataaaaaacagtacgatgtgctgtataatagtaaatgtgaaggagtagggaatgtatagttacttaattggtacggtagttgagatgaatattgatcatattgttgtagaaaatagtggaattggttatttgatatatgtcaataatccatatgaatatacacgaggtaaagaaataaagatttttctttaccaacaagttaaagaagatgcattattattatatggatttaaaacaagtgaagaaaaagaaatgtttttaaaattaattctggtcaaagggattggttgtaaaacagcgataggaattttagctactggtgatgtaacaagcattataagtgcaattgaaacagggaatgtagcatatttaaagaaaattcctggaattggaccaaaagcagcgcagcagattattttagatcttcaaggtaagtttaaaaatacaccaacagcaacaacactgataaataataatgatttagacgaggcggctgaagtattaattgccctaggttataaaaaatctgaagtggataaagctttggcagtcctattaaatgaaaaactagatactaacggttatgtaaaaagagctttaagtttattagtaaagtaggaggtagaaaatgacaaggaatgagattcttgatgcaaatgttattgatgatgatagtagtttgcgtccttcatcattcgatgaatatgttggtcaaactaacttaaaagaaaatctaaaagtttttgttggggcagctaaactgcgtgacgaatcactagatcatgtgttattgtacgggcctcctggactaggaaagacaacgatgtcaatgattattgctaatgagatggggacaaatatcaaaattacaactggtccaagtattgaaaaaactggtgatttagttgctattctaacagcattggaaccgggtgatgttttatttattgatgaaattcatcgtttaaataaagtggttgaagaaattctttatccagctatggaagatttttgtgttgatgtagtgattggtaaagaagcatcaacacgttcagtaagaattgatttaccgccatttactttagttggagcaacaactagagctggtgatctgtcagcaccattacgagaccgttttggaattatttctaaactggaatattacgatgaaacggatttaaaaacgattattgatcggaccagtcgtgtctactcaatgccaatggatgatgacgctaaatcggctttggcgatgcgttcccgcggaacaccgcgtattgctaatcgattatttagacgggttcgagattttgcacagttcaacggtgaagaaattatcagtaaagagcggacgattgaggctttagatcgtcttaaagtagatcaattaggactagatgatgtggatcataaatacttgttaggaatcattcatcgctttaaggggggaccggtaggtctggaatctctggcagcttcaattggagaagaaccacaaacattagaagatgtctacgaaccttatcttcttcaaatcggtttgataaagagaactcctcgcggtcgtgttgcaacgagtgaagcatataaacatttaaatataaatattgatgaataaggctgtttttacagtctttttttgtggaggtattgtgaaaaaacatgaaattattggtttgttaattattttaattatctcaactgtttattcatttacattgcctgaaacatcattaaatgaaattgaatcagatccacaagtaaaaataattgttgaaggtaagtataatgaaactttagtatttaattcttcaccaacaatcgaagatgtatttaaagcattaaatactgataatgtttatggatttgatcaaaaaactgttttggatagccaaacagttttttatatccctataaataaaaatttaatttctttaaatcatgcatcaaaagaacaattgatgacgattaagggaattggaccaaaaactgcagataaaattattgattatcgtaatgaacacccatttgctaccatcgaagagataaaagaagtatcagggataggagaaaaaacttatttgcgaataagggagttattatgtctttaagatatcatttgatttactatgcggtagcatgtttgttaggtgttttgatcatgttgattcatccagtttttttagtgctcttaattatttatgcgttctttataattcgtcattttgggtgggagcgacttgtaacgatagggctggttatgattttctttttagtgtttattaggtggcctcagccgaccgatgaaccaattataagcgggtatataattagtagggatgaaaagagcattgtattgaaaacaacaaaaacaaagatcaaagtatatggtgagtttattggctatgaagttggtgatgaattagaaattgaggttaattattttgaaattagtcgtgcaacaaacgataacgcatttgattatcgtaactatttgtatagtcaagggattactaataatgcatctttactacgccttataaatagtcaaaaacataatacgctttttcaaaaacttcaaaaacgaatagacggtaaagagctagttaatagttatgcaagcatgtttattttgggaataagagatgaaatgatcaatgattattatcatcaattaacagagttgtcgattgttcatttgtttgctttgtcaggactacatattcatatattaagaaggttgattaaaaaagtattaatttttttattaccggaatatttaattaattacctcagtctaattataattggtgtgtatatgtatattattccatataatatttcttttatgcgggcgtatttagtaatgcttttgatgactttgtttaaaaagtatctaaatcaattagactgctttagtcttgttgctatgttttttgtatttatgaatccatatattatttataatttatcttttgttttttcctattttatgtatttaataattattttgattaatcatcataggtacctgaatgagatagtttatggagctagcgtaccaatcgttatttcgattcaatatcgaattaatatactgtcattgtttttagggattattttaacaccactgatttcagtgttatatcaactgctatggttatatgtgatttttggtaatttctttaaaccggttattagtctagtaattgaagttctagataatattgttgtttttagtacggacttctctttttttattaatttttctaaaccatctttattttttattttaggatattactatatttattttaaattaatagtcaaaataaatattaaacagcgaattcaccgtgagattctattactgctaagtttagtgatcatgttttattttaaaccatactatcagacttttggtcaagtggttatgattgatgtaggtcaaggtgattgtttttttattcaacagccttataatcaaggaaatattttaatcgatactgggggattgcgaaataaagatctagctgctttaacattagtaccatatttacgttcggtaggagtgtttaaattagatcatgtttttatttctcatgatgattttgatcatagtggagcttatcagtcacttgcggatcaaattgaaattggacatactattacatcataccaagataaatttaaaattgggcaggtagaaattgagatactgaaaacacctgaatcaacagataataatgatagttcgttagttttgttggtaacgatcaataagttgaaatatttatttacaggggatatatccaatgcagtagaacgacagttgatcaacgattatccagagcttaaaattgatgtattaaaggtttcccaccatggcagtaatacggggactagtgcagcttttttaaatgcaataaaacctaaaattgccctaattagctgtggtaaagataattattatggtcatccccatgatgatgtaattacccgcttaaatgattatggagtaaaggtttatcgtagtgatgaaatgggcatggtgaagattgtttattatggtgatgataattatattttcaatgactttaatgattaaatagtctataattattactgttggaggaacgataaatgatatttgtaatatatggtgaagaaagttttttgatggaacaaaaattacagtctttaaaaaaagaatatgattgtaatgaggataatatgaatatttcaacatatcgggctaatgaagatagtttagaagaagtttatgaagatttgatcacacctccttttttaaccgacaagaaaatggttgtgttgaaaaacccttattttttaacgacaaagaaagtaaaaaaagataataatgagttagagtattttgaaaaatgtttaattaatagtgaagaagtaatatttgtaatttatcatgttggtaaagattttgatgagcgtaaaaaaattgttaaaaatttacgtaaacaagcacaattttttgaaatagataaagttaatcattataagctatcagacagtacacgtcaagcaatcagacgtcgagatgcaacgatcgatgatgatgcattagaattattattgagtcgtttaggagatagtttgaataatgttgctcttgaggtggaaaaactatgtttgtacagcaaacatattacatatgatattgttgatgaattggtaagtaagccgttggatgaaaatgtttttgcattaactagtgcgattcttcaaaaagatcgaagaaaaatgttttcgatttatcatgatctaatgattttaaatgaggaaccaattaagttgattgttcttatagcgggtcaaatgcggctaatttaccaagttaaattattggatcgtaaaggttataatgataaagaaattggaaaaatactgggagttaatccttaccgattaaaatatgttcgtcaagaaggaaaagattttgatttaaatgaattattgcaatgtttagatgatttatcacgtcttgatgtagaaatcaaaacaggtaaaatggataaaaaaatgggtttagaattatttatggtaagaatttaggaggtattatggaatcattaagagagttatataaaattggggttggaccatcttcgtcccatacgatgggaccacaaagagcggcattaaaagttaaggaaacctatcctcaggctacacattttgaagtatatctacatggctcgttagcattgacagggaaaggccatttaacagattacattattgaagaaactttaggtaaagatagtgttaagatacactttgttaatacagcattacctaaacatccaaatgggatgatttttgaaatatatcgggaaaatcaattgcttgataaaattacagtttattcagtaggtggtggagctttaatgtatgatgatagttctttgcaaccttctaagcaagtatatccgcatggtaatttaacggaaattttagaatattgtgatcgtaaaggaatcaatttatatgattatacaatcgagtatgaagatgagcattttaaagcttatttatttgaagtactaaatgcaatgtttgcttgtgttgaagctggattatcaacaacgggagttattccaggaaaactgggattgaaaagagttgctaaatcaatgtatcaacaagcaatcaacacacgtcgtagtggagaacgagatcgcttattagttagtagttatgcttatgcggttagtgaagaaaatgccagtggacatcgtattgttactgcaccgacatgtggagctagcggagttttaccagcagtcttatattattgttacaaacaattagaaattcctcgaaaagagattataaaagcattagcagtagctggaatatttggcaatgttattaaaacaaatgcaactatttctggcgctgatggtggttgtcaggcagaaatcggaagtgcttgtgcaatggcagcggctgcttatggctggattttagaacttaataataatctgattcaatatgctggtgaaatgggcttagaacataatcttggtttaacatgtgatcctgtaggcggctatgttcaaattccttgtattgagcgtaatggttttggtgcacttagagcaatggatgcggcgatgtatgctaagcagctgggttacttgagaaaaaataaagtttcttttgatgcggttgttcgggtgatgaaagaaacaggaaaagatttaaatagtgcgtataaggaaacttctttaggtggtttggctaaagaatttggttttgaaaatgaagactaattcattatatctgcatattcctttttgtgaacaaatttgtgcatattgtgacttttgtaaagttttttataacgaacatcaagccgatgattatttggcggttttaaagcatgaacttcaagctttaaatattacagagccgctaaagactatatatattggtggtggaacaccgagcagtttaaatgatgaacaattagaatggctgatggatattattaaaccatacataagtagtgagactaaagaggtgtccatagaagttaatccagaaagtatcgattattataaattagatcttttaaaaagaggtggtgttagccgtttaagtatcggggttgaaacatttaatgatatccttttaaaaaagattaatcgccagcatacgagtatacaagttgagcggattatcgattatgcacgcaaaattggttttaataatatttcaattgatcttatgtatggtttgcctaatcaaacgattacggatataaaaaatgatttagctaaggttagacagttaccgatcgagcatatttcttactactcactaattttagaagatcatactgtcttgaaaaatctaaattatcaaccgcttgatgaagaggtggaatcgaaaatcactcaattgatagaggaatctttagaacaaatagatttccataaatatgaaatcagtaattttgcgaaaactggatatgagtcacttcataacctagcttattggcagtatgataactattatggaattggggtaggagccagtggaaaaattgatgattgcttaatagaacataatcgtaatttaaatgcttatttacgtcgtcaaaatacaatcacaaagatgattaattctaaagaagaaacgatgtttaaccatttaatgatgtcattacgtttggtgaaaggcttagatttaaaagaatttgaaaagagatatggtcttagagcagttgatgtttatcaaactgctattgataaacatttgaagatgaaaacgttagtaattgaaaatgattatttacatgcaactagtgaatcaattaagttattaaatgaaatcttaatagattttttataaacggggataattagatgagttatcgtatagtgaacggttaaatcttctaaattgggtttacaataggaaataaaagatgtataatcaaatagtaatcattactaataaggagattgggatatgaacaataaagcattttttaagttaagttatgggttgtatgttgtatctagcagttgcgatggtaaggacagtgcttgtattgctaacacttttgtacaggttacttcagagccggcacgagtttgcattacgctgaataaaaataattatactacatcgttaattgaaaatagttgtgtttataacgttggggtattacttgatgatattgatatggatgttatcagaagatttggttttcagtctggtaaagatgttaacaaatttgatgggattgattatgaagttgattgtcaaaatattaaacaaatcaccgaaggaatagctgcttcatttagtgttaaagttatttcaatgacagatgttggaacacatattatgtttgttggcgatgttattgattgtaaagtgattaatgaaggtgaagtattaacttatgcaaattatcataataagaaaaatggaacaacacctaaaaatgcttctagttatcaagcagatacttcaaaacatggttggagatgtactgtttgtggatttattttagaagcagatgaattgcctgaagattttatttgtccagtatgtaaacaaccggcaagtgtttttgaaaaaatttaacagccttagggctgttttttttgtgattttatcaaggaattagattgattatagagttgttttaaatagaaatcggatttataattctttttttattttttagcacaaaggtgttgacagtgctaattattgatgtataatgtatttagcacaaaggaaagatgagtgctaagggtggtgaaactgatgcttacagcgaggcaactattagtatttaaatgtattgttgatgagtttattgaaacggctgaaccagttgggtcaaaagctttgatgacaaaatatcaattgccttattcaagtgcaaccattcgtaatgagatgagttttcttgaagagtatggttatttagaaaaaactcatacatcttccggacgagttccttcggttgaaggatatcgattctatgttgataatcttgcaaagcgggatctagatgaagggattaaaaaccaagtagcgcaaatttttagcgatcgtcatcgtggtttgaatgaaatcattcatgaaagttgtgagatgttaagtgaactaacgcatctaacatcggtagtcttgggaccagattctagcgaagatactttgcagcaaatcaatattgttcctttgaatgataaccgagttactgcgattattattacgaatcaaggctatgttgaaaacaaggtgtttgatttaaaccgtaatcataaaattgatgatttggtgagttgtgttgcagtgatgaatgatttattgatagggacaccgattgatcaggtagcatttcgtttagaacgtgatgtaaaaccggtgttatcagctaaaatcaaggagcatgaggaattatttaatgcttttcttgaagcttttgttcgatttgcttcgagcaatgtatatttttcaggaaaagaaaatatgttataccagcctgagtataatgatgtaaataaattgagaagaatcgttagtgcatttgaaaactctcaagtatggaatgccttacaacctttatctgatgaagaaggagtaacggtaagaattggttctgattcaccgattaatgaaattgaggatgtatcggtcatctcagcttcatttagaacaggagagagaaccaagggatctatttcagtaattgggccaacaagaatgccttatgaaaaagtagtttccttagtagagtatatttcaaggaatattgaagaggcgttctttgacgaatcagatgattcaaacgatgaatagaggtgaatgtagtggctaaggaaaaagaaacagtagtagatgaagaatctacagaaaagactgcagaagaaacagttgaaacaaaagaagatgaaattacagttgaagatcaacttaagaatttagaagatgaagtaaatacttggaaaactgattattataaagtgtttgctgatatggaaaatcttaagaagagattacagaacgaacatgctaatgcaatgaaatttatgatgcaatcatttattgaagaattattacctgttgtagataattttgaaagatcattagctgtagttgatcctagtgatgaaattaaaaactttttgaagggttatgaaatgatttataaccaactgatggaagtattaaagtcacaaggtgttgaagtaattaaaactgagggtgaagagtttgatccaaacttccatcaagcagttatgaccgtaaaagatgataactttaaaacaaatatgattgttgaagagttacaaaaaggatataagttaaaagatcgcgttattcgtgcatctttagtaaaagtaagtgaataaataggaggaatttaattatgggtaaaattattggtattgacttaggtacaacaaattcatgtgtcagtgttatggaaaacggtgaagttaaagtaatcgctaatccagaaggaaatagaacaactccttcagtagtatcatttaaaaatggagagattatcgttggtgaagctgctaaacgtcaagcagtaactaatccagatacaattatgtcagttaaacgtcatatgggtactgatcataaagaacatgcaaatggtaaagactatacaccacaagaaatttcagcaatgatcttacaaaacttaaaagcaacagctgaagcatatttaggtgaaactgtaacacaagcagttattacagttcctgcatactttaacgatgcacaacgtcaagctactaaagatgctggtaaaattgctggtttagaagtagaacgtattatcaatgaaccaactgctgctgctttagcgtttggattagataaattagatcaagaacaaaaagtattagtatatgacttaggtggaggtacatttgacgtttctatcttagacttagctgatggaacttttgaagtattagctactgctggggataataaacttggtggtgatgattttgatgaaaaaatcatgaattgggttgttgaagaattcaaaaaagatcaaggtgttgatttatcaaatgataaaatggcaatgcaacgtgttaaagaagctgctgaaaaagctaaaaaagacttatcaggaactatgcaaacacaaatttcattaccattcatctcagctggtgcagcggggcctttacacttagaattaacattaactagagcaaaatttgatgaattaactcgtgatttagttttaagaactgaaactcctgtacgtcaagcattgaaagatgctggtatggacccaactgaaattcatcaagtattattagtaggaggttctactcgtattcctgctgttcaagaatcagttaaaaaattattaggaaaagatccaaataaatctgttaaccctgatgaagtagtatctatgggtgctgcaattcaaggtggggttattgctggtgatgttaaagatgtattattactagatgttactccattatcattaggtattgagactatgggtggtgtaatgacagtattaattgaaagaaatacaactattccaacaactaaatctcaagtattctcaactgctgctgataatcaacctgctgtagatatcaacgttttacaaggtgaaagatcaatggctaaagataataaacaattaggtttatttaaattagacggtattgaaccagctccacgtggtgtacctcaaatcgaagtaactttcagcattgacgttaatggtatcgtaaatgttaaagctaaagatttaaaatctcaaaaagaacaatctatcgttattcaaaactcaactggtttaagtgatgaagaaattgatagaatggttaaagaagctgaagctaataaagctgaagatgaacaaaaacgtaaagatatcgaaacaagaaataaagctgaacaaatgattaatgaaatcgataaagctttagcagaacaaggtgacaaaattgatgctactcaaaaagaatctgctgaaaaattaaaagatgagttaaaggcagctttagataacaacgatatggctacattagaagctaaaatgtctgaattagaacaaatggcacaacaaatggcttcatatgcatatcaacaacaaggtggagcaggagctagtgatgcaaatgctggtacagcaaatgcacaagatgataatgttgttgatgcagatttcgaagaaaagaactaatcatttaaagccaaggctttgccgccttggttttaaatagtataaaaagagggtgaaaatatggctgataaaagagattattatgaagtcttaggtgtaagtaaacaggcttcagccgatgagatcaaacgagcttatcgtaaaaaagcaaaacaatatcatcctgatgtcaacaaagagcctggtgctgaagaaaagttcaaagaagtccaagaagcttatgaagtattatcagatgctaataaaaaagccacttatgaccgctttggtcatgctgcatttgagcaaggtgctggtaatggtggtgctggtggttttggtggatttggatttgaagatgttgatttaggagatatttttggatctttctttggtggtggcggaagatcacgtcaaagaaatacaggaccacgtcgtggtgatgatcgcttaatgcgtttaaatatcagtttcatggaagcagtaaatggtgtaaagaaagatattaaagttacttatgatgcaccatgtactcattgtaacggtagtggggctaaaaatcctaatgatgtccaaacgtgttcacgctgtggtggacgtggaactgttcaacagcagcaaagttcaccatttgggacatttgtaactgaaactacttgtcctgactgtaatggaactggaaaagttgttaaagagaaatgtccacattgtcatggacgtggatatgaaactaagacagtgacagtacaattagatataccagctggtattaattctaatcaacaattgcgcgtagctggcaaaggtggacgaggagcaaatggtggacctaatggagatttatttgtagaaattcaagtaggaagtcacgaacattttaaacgtgaagggcgaaatattcatattactattcctgtttctaatgtagatgctacattaggatgtgaagttgatgttccaactgttcaaggggatgttacagtaaaaattcctgctggaacacaatcaggaacaatactgcgtctaaagggtaagggcattaaagatcttcgtagtactaattatggtgatgaaatggttagaatcgaagttaagattccgactaaactttcatctgaagaaaaagaattatatactaaattatcaaaactttcaaagaagaaagaatcaatttttgatgcatttaaacgtcaatttaaaaaataaaaacgaaggaaaaatattcttcgttttttatttttttaagaatgattattttttttcatttcaatgattaatcttttcatatgagcttcaaacatgatatacatgccaataaaaattgtttcagcaatcagagaaaaagatatcataataactacaacagaagccaatggaccgtatacgctagtataatctgctatgctaaaataaaattcaagagcagataataaaattaacatcagtatacttgaacaaaaggctccttttacaatgtcaaaaatgtgaacatgaacatctggaataatcttatataataaaaataaaataataaaaaaaactaaaaataaatataaatcaccaagtactaaaatatctttaaaattaataaaataattaattagagggatgattgttaatatggatattattagtaataataaaacgaaaacagcaatcgtttttaaaagcattaataattgttcaataattatattcctttgatgtgcagaaggaaataagttttttgaaattccataaagctggttgattcctcgactaacaacaaataatgagataaataagataattattgatgataaagtaatatgacttgattttaaggatgcaattattatgttagaaaattcaggagttaagtagttttttagtaattgttctaaggtgccaagatcaacatttaatatggaggcaaagaaggcaaacagtgaacaaatcggtatgattgacatgattaaatagtaagcaaagcataaaccagcatttttattaactttatagcggtagtcgaggacccgattattaatacgataatataatctttgaattagttttttcatttctatcacctactttttattgtaccttactttttatttagatgtatagatattaaaacaaaaaaattagccaaaacggctaatttttagattaatcattttttatatcgtcaccattggtagaaataacttttttataccaataaaaacttttctttttataacgtttcatatcttttaagtctttatcatcccgattaacataaatagtaccatagcgtttagacatctctccttgagaactcaaaatgtcaattggtccccacattaaatatccacgacagtcaacaccttcattaattgctaatgcgatttgctcaagatgatctttcatgtaatcaattcttgtatcatcgataacggtttcattttctaaaatatcacgcattccaaagccgttttcaacgaccataatcggtaaacgatatttcgcataaatatcccttaaaccaatacgtaaaccaaggggatcgatttgccaaccccattcactagcttttaaatatggattggtagctgcttttgcattaccgttcatttcaatgcttagtttgccatgtgaagctactgttgaaaaataataacttaatgatagccagtcaaccttattctttttgagcaactctaaatctccatctagcatttttggcagattattttcatttttcatttttgccatcatataacttgaatactccccgtacgtaaacatatcaaaatacatgtctgtaagtgccatttgatttcgagattctagctcgtcaagaggattacaagtggcggcataagcaggaatatatattaccattcctaagactttagcatcagcgatagtatgaactttttcaacaactttagcatgagcaacaaaagtattgtgaaccagctgattaataaatgtttgttcgtcaatgtcttttggacaaacggcaccataagctaccttactgctgcctggtaaagcaattgcattttgttcgttaaatgaaatccatttttttactcgatcaccataacggtcaatcattttattagcataggtaacaaacatatctactacttcccgtgaataaaatccgttatatttattcattagcaattggggcatttcgaagtgatataatgagcacattggctccattccatgccgaatcattgaatcaataaaatcatcatagaattgcatactttcttcactaaagttaataccatctgggcatactcttgaccagtcaattgagaaacgataactggtgaagcccatttcttcaaataatgaaaaatcgtcatcataacgatgatagctatcaattccgtctttaaaatcactatgttctggtttagggaagagatcacacactgcaggacttttaccacctgcgttataagcaccttcgctctggtgagcggttacagcaccaccccatagaaaatcttttggaaatgtcatttaattatcctcctaatttatatagtattatcatattaggaaataattgaggtgtaaatacattggccttgtttattaatatagtttcattgaataagaaaataatgtaaatttaatgaaaaaaagtttcaaaaaaaccaatcatagaataactataattggataaaataaaaatagtaccgcagtactatttatattattaagctgattttctcaaagttcttaattctctagcagaaattcttacagtcgtaggtttaccatctactaaaatagtagctttttgtaaattaacattccattttcttctacttgagtttaatgcatgagaacgtgtatttccagacataggtcctttaccactgatttgacattttcttgacataggttctcctcctcttcattagtagtgttttaacgtacttgcatatagtatcatttttagttttaaattgcaattattttttgaaaaattattacattttttttgcttgaattttttttatggtttgttacaataatttctgactgcaatataattgtcaagaacgaatttttaagatataattagttattgatgaatacaattcaattgtatacgaggaggtatataaatgattgaaaaaaataataatatgggaactgttaacatttctttagatgttgttgctacaattgctggcggtgctgcaattgaatgttatggcgttgttggaatggcaagtcaaaaaaaattaaaagatggttattatgatttgttacgtaaagaaaattattctaagggaatcgttgctcgagatggtgaaactggtttaattttagatctatatgttttattaggatatggaattaaaatgacggaagtattacgtgaagtccaaaagaaagttaaatatgtagttgagtctactttagatgtaaatgtcgaatcagtgaatgtatatgttcaaggtgttcgaggaatagagtagaggagatagaagatgaaagttgtaactggaaaattatttaaagagatggttttatgtggcgcaaatacgttgcataataatcatcctgaaattgatgcattaaatgtctttcctgtacctgatggtgatactggaacaaatatgtctttgacattttctgctggtgctaaagaaattgagggaatggattcaaataatattggagaaatttcaaaaaaattatctaagggacttttaatgggagctcgaggaaattctggagttatcttatcacaaatttttagaggggtttcaatggcacttcaaggtcatgaagaagctgacgcagtactttgggctcaagcactagaaagtggtgcaaaggttgcttataaagctgttatgcgtcctgttgaaggaactattttaacagtgattagagaatcgagtgaagcggtagtaaaatacgcaaagcctggaatggaaattgaagatgttttctcttattttgttaaagaagcagaggcttcattagaaagaacaccggaattattaccagttttaaaagaagttggagtagtagatagtggtggagcaggactactattagtttttactggctttttagctggattagcaggagaaacagtcgattatgtagaaattaaatcatctgattccgcgatgaatgctgtagctgatattgaaggtggagaagaaggttatggatattgtacagagtttattgttcgtctagagccttctttggttgataaatttaaagaggagcaattaaagaaagaattagcgagaattcctggtgaaagtattgttgttgttcaagatgaagatatcgttaaagttcatgttcatactttaaaacctggtaatgctttaaacattgctcaacgatttggtgaatttgttaaactgaaaattgaaaatatgcaagaacaggcagatactattcaaagtaatgcaggaacgattgtcggagttgatgacaatgctaaaccaaaacgtgaagctaaagaaacagcagttatctctgtttgtgcaggtgatggtctaaaggatgcttttttagaactacattgtgattatgttgttagtggtggacaaacaatgaatccatcagctgaggatatggttcaagcagttagagatgtaaatgcgaaaaatgtaattattcttccaaacaattctaatattgttatgactgcgcaacaaacagcaacaattttagaagatgaagtaaatgttattgttattccaacgaaaactattcctcaagggttatcagcatgtatcatgtttaatcctgatgcttcattggatgataatgttgctgaaatgacagaagcagtaggaaatgtaaaaacaggacaagtaacttttgcaattaaagatactaatatcgatggtgtagaaattaaagctaacgactatatggctttggtggaaaaagatattgttgcttgtaaagataataaattaaaagcattaaaagttgttttagaaaaactagtagatgaggatgctgaattgattacattgatttatggtgaagacgtaaatgatgatgacattgaagaaattgaaagttttgttgaagataattttgaggctgaattagaagtagtaaatggtaaacagcctgtttattcatttatagttggtgtagaataataaagagaaattaaaaaataatgtattgtagtgacccctaaaaggaggtcactttttatatgggatagtaaaaaatttaaattagaatatatttaaaaatataaggatgggaatatctaaaaaatctatcgagtgtatgtcataagaatttttgactcgacgagtagaataagattagaacataataagctgactttatccatcgaaaaaaatggaactgataaatagagttggaaacagaaaaaattatcggttagtagctttaactgccagtataaggcgatgtattaataaaaaactcaacatcttagtttgcaattattatttaatctcaaaaggattaatctttcatttagatcaagaatgacattgtcagcataaaacctatcaaaaatggttaagtgataaagaaatcaagtaattacattctcataaagaaaattgcatgaacaattcaaagctgcaattattaaatatatcgagtattataataatgagaaaattaatacaaaaagaaaaggattgagttcgcttgcatgtagactacagaccttttcaaaattcagttttaatttaatatgtctaactttttggtgacattacataaatatagcgttttataatataaataagtgaataagagtaaaagataagaaaaaatttgatattggggtaatttgtcattaaccgaagtatatgtatataaatatttaataattcatatatattctttgcataatccttgagaatcaaagtgattattaaatatcatgcaaaattagattttagaatgaatagtaatgtttttaaaataagttagtaaggaatgtgataaatattggagtgtctttattgttttaaacacattatgtgaaatattactgttctaatatataaatttataataaatatcttgtaaataaaagtgagttaaatgataagataccaaatgattacatttagtgcctttttaaaagttatgtttgaaattcaaataagttataatattatagataatgatcgctatcatggatataacagggattaatcagaaattataaaaaatgatatattctacttaaattgtaaattttgagtggtaacataaagactgtttttatggactagtatataaattaagtttttttattattataaattggtttggctctacgatttttatcgtagagtttttttgtatttgaattgagtgtagaatagggcacttactattaaacgctagatcataaaatttatttcttatgcataaaagattctcataaagaagccacaactaatttcttatttccaataatttaataaaaacaggctgaaataaagtaattaaattttatttttaacctgttttaaaataaaattatttataaaaaattatagtctggaaattttattaatttgtttctttttaaattctaaacttgaatgtacataaagattaagcgtggttcctacatttgaatgaccaagcatttcactaagtgatttagtatccacttcgttcataacgcaattagtagcataagaatggcgaagagtatggaagttagtattaaaatcaaactgtttacataatttgttaaaacgatactgagttgttctgggatcaggtattttattattgccggtaatgataaaaacattattatcttcgatttgatatcgacttttataattaactaagaattcattaagaaataatggaataggaacaattcttttagatgaactggttttagggttaagtatcatgagtgcagttttattaccggtgtcctccttgctttttaaacgttcaactgttttatatacataaatatagttgtcttcaaaattaatatcttcccattttaaagcacaaatttcaccaatccgaagaccggtatataaagaaatggcaacagctatagagattggttgaaaattattaaagcagtagttagataaattgattttttgagaattagacaacgtattaatttgtctttgtttcttggcaattttaattagctcaaaactacaattattagttttatatttttgatgagaataattaataatggctcttaatacatatcgaatacttagaagggtactattggcatagttttctttagtagacagtttattaaaataggcaatgataatatcttcattaaactgttccatcgtataatcattgaattgatgggctaactgtgtgtcaataacgactctatatttagcaattgtcggatattttactgatagcttttttaactcaatccattcatttgatatttctttaaatttttttgtcttcataatttgcttttctccttatttttatatttacttttctatgaatacgtcaattatttgacattaaaaaagtataaagaaaaaattaatatacagatagtgtcaaaaatcattacaaaaatttatatttagtttttttaataaaaagataacagttattgcatggtttattttattgaatatgggataaagaagattaaaggtatcaaagataatatttactagttttgctatttataatgctttaaaggtatcatactgatagatgataggtattagacattataatattcctaatatacaatgtttttgtaaagaaaaagggaggtagaaacaatgttttctaataaggcattaaaaaaactaattttaccactgatcattgaacaaattttaatcatggcagtaggagtagctgatactgtaatggtatcttatgcaggtgaggtggctatttcaggtgttggattagtagatatgttcaataatttaatcattactgtactagctgctattgatgctggtggagcgataattgtttcacaatatattggaaataaagatcgaaagaatgctaacaaagcatctagtcagcttttgacgattacaatagtaattgctactgtaattatgctggggtgtctcgtatttcatcgtatactccttagtacattttttggtgcgattgaaatggatgttatgaaagcagcaacgacgtattttctaatttcagctatttcttttccatttttaggtgtgtataattcagcagcggcattatatagatcaatggaaaaaacaagaactacgatgtatgtatcaatcttaatgaatattattaatgttgttggaaattatattggggtatttattttacatgctggagtagcaggggtagctgtaccaacattgatatcaaggattgttgcagcgattattatgttcgcattatcactaaactcatctaatttagtttatgtaaagattaaaaacgtatttgcatggaatcaagaaatgattagtagaattttaaaaattgcagtacctaatggaattgaaaatggattatttacgcttggtcgggtgttagtaacgagtattgttgctttatttgggacaagtcaaattgctgctaatagcgttgctggaagtattgatcaaattgcagttgttgttgtaaatgcaattaatttgggtattgtagttgttgtaggacaatgtattggagccaatgattatgagcaggcaaaatactatataaaaaaattaatgaaaatatcctatattgtcacaggaatcattggcagtgctgttatattgttattgccgtggatcttgaatctatattctttatcaagtgaagcaagaaatttaacttttattttagttattatgcataatatcatggcaacagcattacatccaactgcttttgttttaccaaatggattacgggctgctggtgatgttaaattttcaatggttgttggaattgtatcgatgatcttatttagactaggtgcagccgtgttatttggaattatctttaatctaggaattattggtgtatggattgcaatggggtctgactggttatgtcgttcagtttgttttgtaataagatttataaaaggtaaatggcgtcaatttaaagttatttaattaatagtataaataaatgaaaacctatataatattgatataagtgattgaaattggtatattgattgttttttgccaactacctcattattatttaggttttattttatcataattataaacgactattaagaaggtgaaaaaatggaaataagagtattgaaatattttttgacagtagcaagagaaggaaatatcactcgtgcagcagaattattgcatattactcagcctactttaagcaggcaattaatgcagttagaagatgaactaggtgccgtcctttttattcgtggaaaacgcaagatggtcttgactgaagagggaatggttttgaaaagacgagccgaggaaattattattttatctgaaaaagcggaattagaagttggcagtcaaagtcatgatatcagtggagaaatagcaataggctgtggagttacagaagctactcagacaatgggaaaattaataaaaaaattttcagaaatatatccccatgtatcttttcgaataagaaacggaaatagtgattttattttagaaaatattgataatggcttgcttgatattggagttgttttagagccggttgagcttgaaaaattaaattttattcattttaacgctgaagaaaaatggggaatattaatgaaaaagaatgcttcactggcaaaaaaagaatatataacatctaaagatctaatagatttacctttaattgcttcagcgcgtagtgaagcgcagactatattttccaactggtacggaacaggatatgaaaatctatcattttgtgcaacttctgatttaacgactacggcggcaatattagtgaaaaatgatgtaggttatgccgtagtggttgaagggtcaatttgtgatgcggcaagtgacgaactatgctttagacctctctatccaagtttaaattcacattcattatttgtctggaaaaaatatcagtcatttagtttaactgttacaaaatttattgattttatttctaaggaaataaagaagttatagaaaattattaagagattgacgatactagtctaaattatcattgattaatttctttttactaagttcataaagaaaaagataatagagattaaaaaaattttgtttaatagctaaagatgcgatataatagtactaaacttattttgaaaatagtaagattaatgaaagaaggtattagaatatgattattggaattcctaaagaaataaaaaataacgagaatagagtatcaatgacgccggctggagtatttgccttatgcaaggccggacatcaagtatatgttgaaacaatggcaggaactggcagtggttttaatgacgatgaatataaagaagccggagcaataatctgtagttgtgatgaagtttttgctaaagcagatttgatcgttaaggtaaaagaatatctagaaagtgaatacaaatatttacgcgaagatcaaatgatatttacttatttacatattgcaaatgatcaaccgtttgcacaagcattgattgattcaaaaacaactgcaattgcttatgaaaccgttgaattaaatcataatttgccacttttaaccccaatgagtgaagtggctggacgtatggcagtccaaataggggctaacatgctacaaaaagcaaatggcggcagtggccttttattaggtggcgtacctggagtaatgccggctaaagttgtggttatcggtggtggaaaagtcggtttaaatgctgctaaaatcgcttgtgggttaggtgctagcgtaagagtttttgatattaatgcagaacgtatggcatatatcgatgatattagtaatggggttattcatacgatttataataatgaatataatttgcgacaagctctaaaaacagctgatctagtaattggagcggtattaattcccggagctaaagcccctaaattagtaaccgaagatatggttaaaacaatgaaagaaggtagtgcgattgtcgatgttgcaattgaccaaggtgggtgtattgaaacttgtgatcatatcactactcatgatgatcctgtttttataaaacatggagtattacattattcagtggctaatatgcctggagcagtaccaagaacttcaactattgctctatcaaatgcaactttaccatatattttaaaacttgccgacaaaggtatagaggcgcttaaagaagacgctggatttatgaaaggattaaatacttataaaggatattttacttgtaagccggtagctcaagcacttaatggtaaatataaagaagtagaagaattactttaaatacaagtccttaacgggacttgtattttttctaaaattgaacaaaatttgtcgatatttaaaatatatggtatggttataatattaagataaaaaatattgaagggaatctaacgatggataaaacaaaaaatttatatttaatggtttccaaaacaccaacaagatttggttacatgattagaaaagttggaaggattcgctataatcatagtgccatcgcattagatgaaaatcttcaagcgttatattcatttgctcgtctacagcataattcattatttttagccgggattgtccttgaaacaattcctcgctatacattaagaaaagaaacatttgttgatgttgcaattataaaaattccggttagtttagaacaatataaattagctaatgagattattggggagttgtatggtaatgaagaatatttatataaccttttttcggttcttacttacccagtaacaaagggatttgctacatatcaatcatatacatgtgttgaatttgttatccatgtgttaagccaaatcggttttaaattcagtgccccgggatattattataaacccgatgatctacttactatttttaaagacaatatttattttgaggggaatctcttggattattgcccagatgaaagaatcgatgaacagtattttgcaccaatgagttttgaagttgctaaaaagagtgccaaatgttttggcaaaatagttggacgcagtatattttgtcgaggtgatgattattttaaaaacaaggaaatgttttgggataaaaacaattttcactaaaagggttgacagtaaccgtttacaatgatagtatttagtttgtaaaaattgaaatagtgtgtaactggtaatgcaggcatcaactatactagatttatattaagatattttttatctttatatatttttttagtatatgttgatgccttttttgatgaaaaagcgcgcgttcatctttatcctatagcatacatctttttacagttttatatggaggagaaaatcgatgagaatgaaaaaaagaggtatcatgaaaaaaggactgattttaggattgtcatgcatgatgttgggctctacaataacgattacaagagcagctgagaatacaaaaccccttactgattttggaaatgttttagatgtaactgccgatccaaaagaaaaaatctacgggacatatagtacaaatgaatataataacttttcagatatgggagcttggcatggttactatctacatcaaaaaacagcaacagatctatatgggggatttgctggaccagtaatcattgcagaagaatatccaattaatttatctgattcaattaataaaattaatttagaaaaagtaacagcacaaggaaatgaaaaaattgatttaactaaagcgactactaatgaggtatattatccaggtcgtcttgaacaaacttatgatttggctgagttaacattaaaattaaaattaatttttggtactaaccgaagtgctttgatcgaaacaaaaataattaataaaactaataatgatttaaaattaaatttatcttgggatggacatttatttacttggtatactagtgaaaataaaagtatgggaactactttgagtgaaagtgcagatggggtgaaagttaacttcattgaaaaaagaggcacttgggaatatatgacaacaactgaaaactcatttgatgtagtattaagtgaagatgatattaaaacaacggtaagtgatgatcggttatcatatacaattaccaaaaatgaatcaataacgattggagctgatagcgaatataatacttatcaaacacaaagttttactttcacaaatgaagaaagagtttcagaaaaaactaaagtaactaatttattaaaaaatcctcaaaaatatttcgagaaaaataattctcgttggcaaggatatgtagatactatttttgaaaatggagtagatgctaatgttaattatcaacgggctgcagtaaaatcaatagaaacattgatgactaactggttttctgctgctggagcaatcaaacatgatggaatcgttccatcaatgtcatataaatggttcatcggtatgtgggcatgggattcttggaaacaagtagtagctacaacatattttaatgaagaattagctaaagataatgttcgtgctttatttgattatcaaattaaaagtgatgatgcagtacgccctcaagatgcaggagctatcattgactgtattttctataatcaaaatgaagatcgcggtggtgatggcggtaactggaatgaacgaaattctaaaccagctttagcagcatgggcagttgaaaatgtttatcgtcaaactggtgataaagagtttttaaaagaaatgtatcccaaattagctgcttatcataactggtggtatacaaatcgtgatattgataaaaatggtattgctgaatatggtggaatggtgcatgaaacatgttatgattggcgtaattatgaatatacagttggtcagtatgttgaagggtttggtacagttaatgaagacggttatattttagatgataatggggaacgtattgtatgcccagaagctggaattgaagcggctgcttgggaaagtggaatggataatgcaacacgttttgaccgtgaaggaaacggggcagatgataaaggcattgaaatttatacagtaagaaataatcaacatgcgccaattggatatgttattaatcaagaatcagtggatttaaatgcttatttatatgctgaaaaaggtttcttgaaatcaatggcagaagaattggggtatcaaaatgatgtagtaaaatatacacaagaggcacaatatattcaagaatatattaatgatagaatgtacgatgaagaaactggattctattatgatgttcaaacaaatgaagatggttcagaaaagaaattattagtgaatcggggtaaaggaactgaaggatggatcccactatgggctaaagcagcgactaaagataaagctgcacgagttgtagaaagtatgacagatgctaataagtttgatacatttgtacctttcccaacagcttcaaaagataataataaatatgcaccagaaaaatattggcgtggaccagtatggctagatcaagctctatatgcggtagaagctttacaaaattacggctattatgatgaagcgaaagtggcaacaacgaaattatttgatcatgctaaaggcttgttaggaacaggaccaatccatgaaaattataaccctgaaacgggagaagggctacatactaagaattttagctggagtgcttccgctttctatctgctatatcaaaatacattaacttctactaatacaacatcacaaacaggattcgatattcctaatgtaaatattgaagtaaatataaataaagagttattattagaagctataaaaaaagcagaattaatcaaagaatctgagtatactaaagattcttatcagggtttagtaattgctttagaaaacggtagagctgtatatgatgataaaaatgcaacgcaagatatggttgacatagcagctgctaaattaaatgaggcattgaatgcacttgttaaaattaaaataacggataatgaaggcactagtcctaaaactggagatagcattgaaactataggctatgctgttttattaggtcttacaggaggtgcattagcattagcaggtaaaagaaaaaaacacaattaatgctgtgaggataaaaacacacgattagattcgtgtgtttttagaatgtaaaaaatgtttttgattcaatacaatttattgaccgaaagcactttcaatgataccatagagaaagtggatttcgttggattcggaggaaagaatgaaagagcgaatttttgcgctgttacaaagaatcgaacgaagttttatgttatcaatagcagttctaccagttacgagatcggtgttcggattagcaattgcttttgcaaatgaaacaatgatcacttcatataatttgtagaagattttaggcgaggtgacgataataaatgctctacttgttataatgaaaaaagcgggtttaggaatcattgataatctatcttttatttttgcagctggaatggctttgggaatggcaaaaagagaaagagcagttacggttttatcgtcggtgattgctttctttgtaatgtatgcattaattaatgtgttattggtaattaacggtcaaatcttagctgataattcgatagtaataatgttttaaagggtacgattacggtaatatgcgtaattccgactttagaaatggaaatttttggcggaatagttgttggaacgacggtagcgtacttgcataatcatttttttaccgaactaagctttctaaatgtgtatcctgtattgaaaaattaaaattcacaccgattctttcgatttttattattatgggaattataatgtatgtgatttgaccgcagatttaaagtattatttatacactgggaagtttggtaaatgaaactggatatttagggacttttatttttggtgtaataaagcgtttattagttccctttggactgcatcatgtattttgtctaccattttggcaaactgcagtaggcgggagtatgcttattgatggtttattagttcaaggtggacagaatattttctttgcccaactagctgatcctaacatactctattttagtgtagcagctacgcgctatttttcaggagggtttatatttatgatatttggactacctgatgtggctctagcgatatatcaatgtgccgattcacaataaaaaagttggtatgtagaatattgctgactgcggcattaatgtgtatattaacaggaatcacagaatcgattgaattttcttttatttttatggcaccaatgttatttgggatgcaagtattttggcggaaagtgcttatcttgctgcacatattttgaatattacagtaggattaacttgatttaattatattcgggatattgcaggggaacgccaaaacaaattggctgctaataattccagtggggattatttattttcttttatattatagtagttttaaatatttaattctaaaatataacttaaaaacattgggacgtagtaataacggtaagttgctattgcagcaagatgagaaaaattttgatgttttaacagccagtaaagttatagatggttttaatcagcaattttattatattgtaaaaggactgggtggaaagaataactttaaatatttggatagttgaaataataggtttgttaatgatcttgcaaagatagatgaaaatatactaaagaaatcaggtgttataggaattatttatcgggaattaaatatccagctggtctttggcctaaggcatcaaacctaaaaatgaaattagaagaatatttagaaaagctaaataaggtttaattaggtaagagtaatataaatcaagttagattatagtaagtttataatggtgataaacatgtgaaacataaaatgattttgctgcttaaggaaaacggataagatgggaagggataatcatgtatcgaatagaaaaagtgttaaataataatagtattttagcaagtaaagataatcaggaagttatttttttaggtaagggtattggttttggtaaaaagataaacgatatttatattccaagtgatggagttaaaaagtataagatggaaacaaaagaacaggaaaaaaggttgccacacgagattatcaggaatgttgatcccgtttttattgaaatcgcatccgatataattagatttgctcaagaacaatttgatcacgtagatacaaagattttattgccgttagccgatcatattgattttgcaattaaaagaatccaagaaaatgttaatatgtctaatccgtttaccaaagatattgaattactatttccagaagaatataaggtggcattaaaaggtaaacaattaatcaattcaattactggtttcgaaataactgaagatgaagttggttatataacattacatgttcattcagccattagtactgatcatgttggcgaatcgatgcaggcaatggaaataattcatgagagtattgataaattacgaaaagaattgaatattggaattgatcgtaattcaatctcttatattcgactgatgaatcacattaaatatttattattacgtcttaatactgaagaaaaattacaaatggatattagtgattttacccaagaaagatttccttttgcatatgaacgttctaaagaaatttgtattcgtttatcaaaggtaatgaaaaaagagattccacaatcagaaattggttatttagctttacatttagaaagaattttatcaattgaactaaaataggggatattttactatattttttcataaaataaacagtgaatcgttttatgtcaaaatttatttttaaattctgaaaattgtagtaattttaatttcattgtgataaaatcgtttcatatgtaaatgataaatgtttatggaggtatatttatgtataaaattttgctatgctgtgcatctggtttaactactagtatgcttgtaaatgcaatgaaaaaagatgcaaaagaaaagaacatagatgtgatgatttgggcagttgctgaaagcgcaatcgacttatcttgggctgatgctgattgtattttagttgctcctcaaaatgccggagatcttgaaaaggttaaaggtatcgttaatagttctattccggttgcttcaattgatggtgttaacttttctaaaatggatgggcaagctgttttagaacaagcaattgaaatgatcaataaataagttattcgattgaataacttatttttttatattttgaaaaaagaataaaaaaagtttaaaaagtagttatgattgtcttatcatataaaaaggggaataaatatgtttgatgtgttaataaaggctttaggttttgtaattgtaatagttatcggttttttattaaaacaatttagaatattaaaaaaggaagacggttatactttggcaacaattattatgaatgttacattgccatgtgcacttttttctaatgctaatggaattacgatcaatggtgctatgattgttttaattttaatggggattattttaaacgttttaatggttgcaattgggtattttgttagtaacgggaaatcggcaccaacaagagcagcgtatatgatcaattgttcgggctacaatattggtaattttgttttaccgtttgttcaagcttttttcccaggaatgggtgtagcttatttatgtatgtttgatgttggaaatgcgttaatgggattagggggaacctttgcgattgcttcaagtgttgttagtagtgaacagaagttatccgtaagcaatgtaataaaaaaattattttcatcaattccttttgatgtatatattgttattttctttttagcattatttaaaataaaaataccagctccaattttatcaatcactgattttattggcgctggaaatggttttttagcaatgctgatgattggactgttattagaaattaaaatttcacatgatgacttcaaggatttaatctctattttatcataccgtcttttaggaaatatgttattaatggctttgtgcttcttcttattaccattgccgctgcttgctaaaaagattttaattattgctttagctgcaccgatcagtacagtatctgcagtctttacaagacagtgtaaatatgaaggagaagtagctgctgtagccaattctttatcaattttaattgggattggagtcttagttgttttattaatgctttttgtataatagtagatatttttgtttaaataatatacaatgttcgtggtgataatatgactaaacaaataccgttacaacaattaaaaataaatacaaatcgtattgaattattaaataatatgaatatctattcagttcgcgatcttgttttacatttcccttatcgttatgaatcgattgaagaaacacctttaatagataacgaaaaagttattattgaaggtgttttaattgatgagcctaaaatattttataaggggcgcttatctagattatcttttcaaatattatataagcaggaggtttataaagtaactttatttaatcgtcattttttgaaaaaaaatatgactaaagaaatgcctttgaccattattggtaaatataatagtaaaacaaaaagtatcactgctagtgatttacgattaaaaccacttgatgaaatcagtgggattacaccaatatactcattaaaagaaggaattactcaaaaatcttttcaaggttatgtaaaaaaggcattaaatttttatcatggtcatattcaagacgaggttcctactaatttattaattaaacatcatttaatccataaagaattagcattgaatttaattcattttcctagtaataatggtgatgtaaaagaggcgttacgttatctaaaatatgaggaatttttacgttttcaattaactatgcaatacattaaattatctaggaaagataatttgggaataaaaaagcaatttaatcgccaaactctagatgagtttattgcccaattgccttttgaattgacttttgatcaagaacaagcagcgttggaagtaattaatgatttacaaaaagaaacaatgatgtatcgctttgttcaaggagacgttggaagtggtaaaacagtggttggagcaattggtttatatgcaaattatttagctggatatcaaggagcaatgatggcgccaacagaaatattagctactcagcattatcgttcattaatcaaattatttaaaaaaatagatatcaatattgctttgttaacaggacatttatcaaataaagaaaaacaaagaatctataatgatttagaaaacgggactattgatattgtggttggaacacatgcgttatttcaagaaaaagtaatttatcaaaaacttggtttagttattacagatgaacaacatcgttttggagtaaatcaacgtaaagcactaaaagaaaaaggtaaacaagtagattttatggttatgtcagcaactccgattcctcgaacactggccataagtatatatggggatatggatgtatcaactattaaaacgatgccaagtggaagaaaaccagtaattacagaagtttttaagacacatagtatgaaacctattttaaaccgtttgaaagagtatttagcaagtggaggacaatgttatgttgtctgccctctggttgaagaaagtgaagctatcgatagcagggatgctacgggaatatataatgggatgaaggcctatttcaaagaacagtatcaaattggtctgcttcatggtaaaatggacgatgaaacaaaggatcagatcatggcagcatttaaagctaatgagattcaaatcttagtttcaacaactgtaattgaggttggggtagatgtaagtaatgcaaattggattgttatttacaatgctgagcgatttggattgagtcagattcatcagctgcgtggtcgtgttggtcgtagtgatcagcagggatattgttttttattaagtaattcttcaagtcaagaggcattggaacgtttagaatttttaagaaattgtcatgatggttttgaagtttcttactatgatttaaaattgcgcggaccgggggatatacttggaaatcaacaaagtggattaccggtgtttagtgttggaaatattttcgaagatgccaatattttagaaatttctagaaaggatgcattagaactgcttgaaagcaaatctaatgatttaatatatttaaaattaataaaagaaatcgaagaacaattaatcaacaataataaatatattgattaatttatgttataattatgactaatatgaggtgaagtagatgaaattaggaattgatgccatgagtggtgatttaggaagcagaatagttgtggaagcatgtctatcatttttagagaaaaataaaacagatgaattatatgttgtgggaaagattgaggaattagaagcattaaaaccatatgatcaagtgactttgatcgatgcgcgagaagttctggaaatgacagaaaatattttagccattcgtcgtaaaaaggaatcaagtatggttaaaacaatgatgctggctcgtaagggcgaagttgatgcagtcttatcttgtggaaatactggtgcctattatgcaagtgcaatgttatttttaaaacgtattgaaggtgttgaaaaatcttgtttgatggcaatgatgcctacttacagtgataataaagtagcaatgcttgacgttggggcaaattcagaaaatacagctgaacagttgaaatcatttgcaatcatgggtaacgcttatgctaaaaatgttttaaaaattaccaaccctaaaattgctttattaaatattggaagtgaacatcataaaggtgatgagattcatcaagaaacatataaattgttagaagatatgcaagaaattaattttgttggtaatattgaaggtaaagagattttggatggtgaagttgatgttgtcgtaacggatggctttacaggtaatgtagcattaaagacaattgaaggtgttgcaaaagtgctggttaaaagtttaaaagatggttttatgtcatcaactagaaccaaggcaggagcggttcttgctaagccggctttaaaacagttattgactaaatttgatactaaggcagcaggtggtgctttaatgatgggttttgttaaaccggttattaaagcccatggttcaagtgatgcaattgcttttgaaaatgcaattaacttagcttttgaaatggtttctagtgacgttgtggaaaaaatgaaagaaggattgaattaacgtggaattagaacaatttttacaaaaaatggaaataccttatcagaatatagaaatatttaaggaagcttttacgcatccttcatatgcaaatgaaaataaaatgaaaaatcatgattatgaacggttggagtttttaggtgatgcggttttacagtatcatgtttctcggcatatctttgatttatacccggaattgccagaaggccgtctaaccaaacttagagcaaaacttgttcgtgaagaatcattagcacgttttgctagagaacttgatctaggcccgcttatttatttaggagcaggtgagttgaataatggtgggcgtgatcgtgatagtgttttagccgatatttttgaagcttttatgggtgcgatatgtcatgactgtggaccagaatatgttgaaaaaatgctggatattacgatctataagcatgttgaggatgttaattacgatgaaattacagattttaaaacaaaattgcaggaattgattcaggctgatcagagaaagacggtaacttatgatctaatctcatcatcaggaccgtcaaataatccagtattcgaaatggctgttaaaatggatgagatggtattaggggttggagtaggttcttcgaagaaaagagcagagcaacaggcagctaaagatgcattaaataaattagcaagataacggacttttttatgaagtctgtttttttgcctatttattatttttttatttgaataggttatggtaggagggatgtacatgtacgaagattacatggataatttgtttgatcggcgaccaatgccaacagttgcaccaaaggtaggtgatatctttctatatactgtaaatcgtggtgataacgtttatgcaattgcacgacgatttaatacacgagttgactatattaaaaatatgaatagcctagatgataaaatgatgatctatcctgggcaacaattattagttccagtactatttgaaaaaatgccaccaatgaagccacagccattaccacagccgcaaccacaaccaagacagtcttatgaactatatttctaaaataactagatttttataagaaaaaagtttattataatgataaatatatacaaggagaacaatagatggatttacatgcaggaagtaaacgtaatttaacattggtaatggatctatatgaattaacaatgtcttataattattttaaacaaggcaataaagatgaatatgtgtattttgatatgtattatcgtaaaaatccagataatggtggattctcaatatttgctggtcttcagcagttgattgaatgtatcgaacacctacattttagtgagggagatattaaatatctccgctcactaaataagtttgatgaagaattttttgattatttacgagattttcattttacggggtcaatatatgcggttaaagaaggtacaccggttttccctaatgaacctttaattacaattcgtgcaaaatttatagaagcacaattaattgaaactttattattggtaactgtaaaccatcaatcattgattgctacaaaagctaaccgcattgttcgagaagcaaaaggacgaccggttttagaatttggggcaaggcgagctcaaggctatgatagtgctacatatggagctcgagctgcttatattggtggagttgccgggacagctacagtttctgcggggatgatgtttaatattcctgtagtaggaacaatggctcattcatttgttcaatcatttgaaagtgaatttgaagcttttaaagcgtatgctcttacatatccggatgattgtgtattattagttgatacatatgatacattaaaaagtggtgtgcctaatgctataaaagtagcaaatgaagttttagcgccgttaggtaaaaaattaaaaggcatccgcttagacagtggtgacattgcttatttatcaaagcgagcgcgagtgatgcttgatgttgcgggattagttgatgctaagataacagcatcaaattcattagatgaatatttgattcgttctttattggatcaaggagcccagctggattcatttggggtgggtgaaaaccttattgtttcacggagtgcgccagtttttggtggtgtatataagttagtggctctggaaaaaaatggaaaaattattcctaaaatcaaaatttctgaaaatacggaaaaaataacgaatccaggatataaaaaagtatatcgcttattcgaaaatgaaacaggaaaagcaattggtgatgtaattgcttttcatgatgaagagatttccagtagtcacgatttaacaatatatcatcaatcgaatatttggaaatttaagacaatagctgctaatacatacagtgtagaagagttacaagtaccagtctttattaatggtaaacgggtataccccgaatatactgtagaagaaattcgtgaatattctaatcaacaaaaagcacgtttgtgggatgaagtgttccgcttagaataccctcatgattactatgttgatttaacaaaaaaactgttagattataaaattaagatgttagaagaaaaaagaaagtagttaatggaggaataaaagtggcaagatttgatcgtaaggttgaaagacaaaaaaaggaatttgatttttatcataaagaaaaaactaaaaaatctaagatgactgaatttaaagaaaattttagttttcggtggataaagataaatttacgaacagtgatttatatagttttagattttttggctgtaagtttagctttcattcctttattaatgaaatactatgatgctaaaactgcctttattttagggcatggggtattgacgagtttgttagtagttttaacattctattttatcaataaggaagagaaaccgccactaagcgctttgtttattcgttattgttttatggcattgcttttaggggcaacgtcattgattgcagtatttttagtttaaagtgtaagaaatattataattttatggagcttacttttactgagaataatattacatataaggtaagaccagataattaaataatcgaggaggtctttatgattattacagtagtaggtctcggagtagttggaggcagttttgttaaagccttaaaaggtcaaggtcatgaagtttatgggattgatatcgatgaaaagactttacaaatggcgaaaaatgaaggaactataattgagggatttacagatggaaaagaaattattgcacaatctgacttaactattatatgtttatatccttcattggttttaaaatttattaaagagaataaatttaaaaaaggaagtatcattactgatgcggtagggattaaatcttatttcttagaagaagcaatgacaattattgatcctgaagttgaatttgttagtggacatccaatggctggacgagagaaaaaaggatatgggtacgctagtaaagaagtttttaaaaatgctaattatatactgattgaacatccggttaatcaaaaagaatgcattagttttatggaacgttttgttggaactttaggttttaagagtgttaaaatcatgtcgccacaagctcatgatgaaattatttcatttacatcacagttgccacatgcaattgcagtgtctttgattaatagtgataatgaaaaatatgaaactggtaagtacataggagattcataccgtgatttaactcgaattgcaaatattaatgaaaatttatggtcagagttatttttacgaaatagtgattatttgttggcttcaattgaagcatttgaagaacaactagacttaattaaagtggctttaaaagataatgacgaacgattactaaaagatttatttattaaatcttcgttacgacgggaaaaattagagaaataataggtctaggcctattatttttttgctattaagtataatatattaaacaaattgttaaatgatagttgctttattgacaagattcgttataattagactgttgaaaagaataaatgatggaggtgtcttatggatatcgggagtaaggtaaaaagattacggcaagctaatggtttaactttagaagaactagccaatcgcagtgaattaacaaaaggctttctatcgcaattagaacgggatttgacatcaccttcggttgctactttagaagatattttagaagctttgggaactaatctgcaagagttctttagtgaaaaagaagcggaacaactagtttttaaacaagatgatttttttgaaaatattcaagatgattataaaatttcatatattattcctaatgctcaaaaaaatgatatggaaccaattttaattgaattagaaaaagataaacagtcaatgataattgctcctcatgaaggacaggaatttgggtatgttgttcaaggacgggttaagttgatttatggtgataatgaatttgtgttgaaaaaaggagaaactttctatttgaagggattagtatcgcattatttatttaatcctggggaaactaaggctaaggttatttgggtttcaacaccaccattattttaaaggagacattatgacaaaattaattgaattagacaatctaacaaaagaatataatggtcaagttgttttaaaaggtattcatttagaaattaatgaaaaagaatttgtaactttacttggaccaagtggttgcggtaagactacaactttaagaattatgggtggttttgaagaagctaatggtggaactgttttatttgatggtcaagatattagtgggttaccgccgtataaaagagaactaaatacagtttttcagaaatatgcgttatttcctcatatggatgtttttgataatattgcttttggtttaaaaataaaaaaaatggacaaagaaacaattaagcataaagttaatcggatgcttgatttagttgggttagctggctttggacaaagaaatataaatcagttatcaggtggacagcagcagcgagtagcgattgcacgagctttagtaaatgagcctaaagtgttgttattggatgaacctttgggagccttggatttaaaaatgcgtaaaacgatgcaaatagaattaaaaaatattcagcaggaagtaggaattacttttgtttatgttactcatgatcaagaggaagctctaacgatgtcagatacgatcgtagttatgaatgagggacaaattcaacaaattggaacaccaatcgatatttataatgaacctgaaaatcgttttgtagctcaatttataggagaatcaaatattattgaagggatttttgtaaaagattacttagttgaatttgatggaaagcaatttgaatgtgttgataaaggttttgatgatggtcaagatgttgatattgttttgagaccagaagatttagatattgttgaagttggtaaaggaaaaatagaaggggttgtaacttctattgtttttaaaggcgttcattacgagattattgtagagacaaaagatcgtgattatatggtacacacaacagatattagtgaagtagggaaaaaagttaatttggatttttggcctgaagatattcatgttatggataaaatgggtagctattaatgaaacagtttcgtaagttggttggcccatattgtttttggctgtttgttttgacagttgtaccaatgcttttaattatgatctatgcctttgttcaaaaaggaaatacgattactacatttaattttacattagaaaatttttctaaattttttgatccaatttttgtttcagtattagtcaaatcgtttgttttaggtgcaattacaacggttttatgcttggcaattggatatccagtggcttatgcaatttcaaggtgtaaagaaaaaacgcagacacttcttattttattgattacgtttccaacttggatcaatatgttgatgcgaacatatgcgtggatcaatatattgagtagtaagggaatcatcagtaattttgtccaatttctaggatttggtgaagttagctttttatatacggactttgccgttgttttaggaatggtttatgatttcttaccatttatgattttacctattcataccgctttaactaaaatggataaatctttagttgaggcaagcaatgatctaggagcgaatccgattactactttttggaaaattacttttagattgtcattaggtggagtattaacaggaattacaatggtatttttaccagctatttcctcatttgtaattccaaaattgttagggggtggacagtattctctaattggtaattttattgaacagcaatttattaatgtaggggattggcattttggtagtgctgtttctttgattttagctgttttagttattgtcctcatgggacttattaaccgggttgaaaaatacgcggggtatcaagaggaggctaaacgtgaaaaaactaaaaaactttaagtttaattttaatagtagtttatggattggttttgctttagcgttcttgtatttaccgcttgtgattatggcaattttttcgttcaatgattctaaatcactttcaagctggagtggtttttcattacgctggtatcaagagttatttgtaaatcaacaaatgatcgatgctattgttgtgtcagttagtatcgcaatcctttcaaccgttatttcaacagttttgggaacgatcacagcaattggagtatcaaagtcaaaaccattattacgtaagttagttttacaagtaaataatttaccaataatgaaccctgatatagttaccgggatatccttgatgttgttgttttcgtttattaaagtagaaaagggctatttaactatgttattagctcatgtagctttttgtactccatttgtaattacaaatgttttaccaaaggtacgacagttagatgttaatttagccgatgctgcgatggatttgggggcaactccatttcaggctcttacaaaagtaattatccctcagatcaaaccgggaataatttcaggggctttattggcttttactatgtcatttgatgattttattatttcttattttgttagcgggaatggaattgaaaatatttcgatcgttatttacaatatgtcaaagcgaactaatcctagtatttatgcacttgcgactattatattagttgttgtattactttttgtggcaattggaacattagtgccgaaattctttccaaaagcgacaaataaactattaagcagtaaaactgctaagatagttattgctgtttgtctagttttatctgtagtgtggtcaatttctactggtgtcagtcgtaaaacgttacgagtgtataattggggagagtatattgataaaacagttattagtgattttgaagataagttcgattgtcggattatttatgaaacgtttgattcaaatgaaattatgtacactaaatatatgagtggaaatagttatgatgtactagttccttcagaatatatgattgaacgaatgatcaaagaggatttattacagcctgttgataaatcattaattcctaatttggataatattaatgaaggaattttaggacagtcattcgatttgagtaataattattgggtaccatatttttgtggtaatgtaggtattttgtatgataaaactgttgtagatgaaaaagatttagaagcaggatggagtatcttacggaacacaaaatacaaaaatcaaatttatatgtatgattcagagcgtgatagttttatggttgctctcaaagctttaggatattcaatgaatactacaaaagaacgtgaaataaatgaagcttatcagtggctgttagagcaacgtgaagaaatgaatccggtttatgtaggtgatgagtcaattgatacaatgatcagtggtgttaaggcgatggcgataatgtattctggtgatgcagcagcagtaatgtcggaaaatcctaatatgggttactatatgccgaaagaagggactaatgtctggtttgatggatttgttatttcgaaagagtgcaagcaaacaaaacttgcaaatgaatttattaattatatgataagtgataaagtatcttataagaatactgtcgaagtaggatatttaactgcaaatgttaatgcagcggctcaggctgaaaaagaggagtttaaagatattagtgcttatggactgcgcactggcccgaatgatgaagtatttgcttatcaggataatgctgtaaaagagatgtataattctcgctggacgaaagtgaaagcaaaatagttaaaactgttgattaaaaatcagcagtttttttaaaaatataaatataaaaattattgataaaatgaatcttttttagtgtgttttttcttatatataagaaaatggtaatttttttataaaaaatacttgaaattattttctgtttaacatataataaatgagcagtctggtgatgacaccgactgataaaaacaagaacaacaagttaatggttccatggccaagttggtaaggcaacagactgcaactctgttatcatcggttcgagtccggttggaacctccattaatgtgttgcccaggtggcgaaactggtagacgcacaggacttaaaatcctgcggaccttaaaatccgtgccggttcgattccggccctgggcaccatttcttaaaagaataaatcttgcaaaagctaataagatgtgttaatatagataggcgttgtaagtgaacgatgcgctagtagctcaactggatagagtgcttgactacggatcaagaggttgtgggttcgattcctgcctagcgcgccatttgagtaaaaaaagaaatagaacgggaagtagcacagcttggtagtgcacctggtttgggaccagggggtcgcaggttcaaatcctgtcttcccgaccatttaaaataataattggggccttagctcagctgggagagcacctgccttgcacgcagggggtcagcggttcgatcccgctaggctccaccattaattattaaattatagcattgctgtagttgattacggcggggtagctcagttggctagagcaatcggttcatacccggtgggtcgggggttcgaatcccttccccgctaccaatttaataacggtgcccgtaagtcaagaaacaacaaggacccttagctcagttggttagagctatcggctcataaccgatcggtcgttggttcgagtccaacagggtccaccaatttaagaatgcgagggattacccaagtccggctgaagggatcggtcttgaaaaccgacaggggattaacgtcccgcgggggttcgaatccctcatccctcgccatttaatttaaaattcagccgaaataaaataatgcaaaaaatatcgcgggatggagcagtctggtagctcgtcgggctcataacccgaaggtcgttggttcaaatccttctcccgcaaccattggtctggtagttcagttggttagaatgccgccctgtcacggcggaggtcgcgggttcgagtcccgtccagaccgccaatggttccgtagctcagtcggtagagcagaggactgaaaatcctcgtgtcgctggttcgattccggccggaaccaccatttaaaacataacgaacaatggttcgtttttatttcgggcattgatggcgtgttgtctaaaaaagtataaataaatcttgcaaaagctaataagatgtgttaatatagataggcgttgtaagtgaacgatgcgctagtagctcaactggatagagtgcttgactacggatcaagaggttgtgggttcgattcctgcctagcgcgccatttgagtaaaaaaagaaatagaacgggaagtagcacagcttggtagtgcacctggtttgggaccagggggtcgcaggttcaaatcctgtcttcccgaccatttaaaataataattggggccttagctcagctgggagagcacctgccttgcacgcagggggtcagcggttcgatcccgctaggctccaccattaattattaaattatagcattgctgtagttgattacggcggggtagctcagttggctagagcaatcggttcatacccggtgggtcgggggttcgaatcccttccccgctaccaatttaataacggtgcccgtaagtcaagaaacaacaaggacccttagctcagttggttagagctatcggctcataaccgatcggtcgttggttcgagtccaacagggtccaccaatttaagaatgcgagggattacccaagtccggctgaagggatcggtcttgaaaaccgacaggggattaacgtcccgcgggggttcgaatccctcatccctcgccatttaatttaaaattcagccgaaataaaataatgcaaaaaatatcgcgggatggagcagtctggtagctcgtcgggctcataacccgaaggtcgttggttcaaatccttctcccgcaaccattggtctggtagttcagttggttagaatgccgccctgtcacggcggaggtcgcgggttcgagtcccgtccagaccgccaatggttccgtagctcagtcggtagagcagaggactgaaaatcctcgtgtcgctggttcgattccggccggaaccaccattgatttggcctgttggagaaacggttaactcacatgcctttcacgcatgcattcacgggttcgaatcccgtacaggtcaccatttgaaattagcaacctttgggttgtttttatttttgattatgatatactattgaatattaataagaggtggattcatgaaatataaagagtttagaatgttaattttttcaattatctttttctttgtgattggcggtgtgtgtgtttattttgcactagatcataatcgttcaaaagtgattattggtgtaatcttatcgtttgttgtattaatgatgttaacaacaaaatataatatgaagatatttaatgattcgatgctagtttatgaatttaaaggaattggaatcttaccagctttgatagactataaagatgttaaagaaataaaattagtgagcaaacacaaagttaagataaaacataaaggtatttcaacactttatattttagatgctgagtcattttatgaagaagtaatggaaaatatcgaagaatataaaaaaagcgttaatcaagaagattagcgcttttatcttatctattaataaattccttgagaaatcattgctgcaacaactttttcaaatccggcaatgtttgcaccttttacaagatcatatccaagaccgtatttttcagccgcagcttttgaatgatcgtgaatgtctttcataatttgttttaatttagcatcaacttcttcacgtgtccaattataacgcattgagttttgagccatttctaatgcagaaactgcaaccccaccagcattagcagcttttgcaggtcctagagttccaccgttactaataaagtattccattgcttcaggtgtagtaggcatattagcaccttcaataatgtatttaacaccattagcagttaattgtttagcttcttctataccaatttcattttgtgtagcgcatgggaaagccatatctacttttaatccccaaggtttttcaccagcgtggaattcacatccgaatttttcagcatagtcttttagtttaacatcatttgattcacgaattttacataagaaatcaattttttcatctgtagtaattccttcaggatcatatacatatccatcacgtccagaaattgatacgactttagctccaaattcacgagcttttaaacaaacaccccatgctacgtttccatatccagaacaagcaattgtttttccttcataagaatcattgaaatgttctaatacttctttaccatagtagcatgctccaaatccagttgcttcgggacgaattaaacttcctccatatggcaatggcttaccagttaaaacaccattttcaaaagcaccacgaatacgacgatattgaccatacatataaccaatttcacgggcacctgtaccaatatccccagcaggtacatctacgtctggtccaatatgacgatataattcagtcatgaagctttggcagaaacgcataatttcgttatcagattttccttgtggatcgaaatcagatccacctttaccaccaccgataggtagtgtagttaatgcatttttgaaaatttgttcaaatcctaagaatttgataattccaagatttacactaggatgtaatcttaatccccctttatatggtccaattgcacttgagaattgaacacgatatccacggtttacttgtacttgaccattatcatccatccaaggtactttaaacattaaagttctttcaggttctactaatctttcaagaatagcttgtttttcatattcaggatgagcttcgattacaggtcgtaagctttctaatacttcttcaactgcttgaataaattcaggttgatcagcatttttttcttttacttgcttaaatactttagtaatataatccatttttatattgtcctccttcttgtatatttaatataatactattagtctgataataaataaatcatttaagaaaaaaatattataaataaatataattattatattggataaaaaaataccatctttataatattgtcttttaaaatactatttgtatatcaataaatacatagctgctataaagagagtttccaatatagtgagctaataagttaataaacttattttttgtatacttagcgtgaggattaaaaataaaatttattatttgataataatagatttttctttgtgaaaaagggcaaactatagtagaataaacagtggattctttttagaaatggagtgttaaaatggaagcagcgggacatgtatatatggcgattgatttaaaatctttttatgcttcagttgaatgtattgaaagaaatctagatcctttaactactaatcttgttgtagctgacactagtaaaacagagaagacgatttgtttagcggtatcaccatctttaaaacagtacggtatttcaggccgagcaagattgtttgaagtcatacaaaaagtcaaagaagttaattttcaaagaaaaagagcaattaacgacagaaattttatagataaatcttattttgattctcaactaaagaaaaatccttatttagaattaagctatatagcagcatcacccagaatggctttgtatatggaatatagtacacgaatatataacatttatttgaaatatgtatcacctgaggatctccacgtctattcgattgacgaagtttttattgatacaactagttatttgaaagcttcaagaaaaacacctggagaatttgctaaaatgataatattagatattctagaaacgattggcataacagctactgcaggaataggaacaaacctatacctcgcaaaagtggcaatggatattgttgctaaacatgttaaagcggatgaagatggggttcggattgcctatctagatgaaatgcgatatcgaaaatatttatggcatcatcagccgattacagatttttggcgaataggacgaggttatgaaaaaaaattaaagaaaataggtttatttacaatgggcgatattgccaaatgttcagtgggcagtgaagatgaatattataatgaagaccttctttatagtatatttggtattaacgctgaattgctgattgatcatgcttggggatgtgaaccttgtacaatgcaacatattaaggcatataaaccagaaaataatagcattggaattggacaggttttgagttcaccttattcattcgaaaaaggtaaattgatacttaaagaaatgctggacgcattagcattaagtttagttgataaaaagcttgttacaaaccaaattattattactattggatatgatattgaaaatgtaactacgggtagtctttatcgcgaggaaataattaccgatagatatgggcgaaagattccaaagcatgcccatggaacaattaatcttgatagttatactgcatcagcaaaattaattatcttggcagttttaaaatggtatgaagaacatgttaaaagattcttaacaattagaaggtttaatatttctgccaatcatattattgatgaaagcagtattaaaataaagccgacaatacaacaaatggatctatttactgattatgatcaacaaaagaaagatgaagaaaaacaaagacgtgatttagagaaagaaaaaagacttcaaaaaacaactttggagttaaaaaagaaatatggtaagaatgctgttttaaaagggatgaacttagcagaaggagcaacagggagagaacgtaataaaacaataggcgggcataaagcatgacaaaaaacattcatgactatcaagatattattaatttaccacatcatatttcaatcaagcatccacagatgtcattagaagatcgtgcagctcaatttgctccttttgctgcactgacagggcataaggactcaattaaggaaactgagcgactaacagctcaaagaaaaatcttggatgaagatcgtatagcaattattaatttcagattacaacaattattaaagcatcttactgaagcaccgttaataaaaataacatattttgaagcagatcaaaaaaagtcgggtggacaatacattacaattataaatcacctaaaaaaaattaacgaatatgaaaatttattagtgcttgaaaacggtgtaaaaataaatattgatgatatatacgagcttgaataagttaatggttattatgagataagtttattttagtaaaaaaatattgctattttcatgtggctggatgtatataatattttagttttaatgataattttatggtatcaaaatagagatgattagaactaatagctgttagtttatctaatcatttttatttttgaataaaaaattgtatacttaaattgattatttaaataattatgaaagttgagaaagtatcaatgagatatccatattgtgctagcgagatgatccttggttatatttattcggggaaaaatgatatttgttggactccggataatgaaaaaaatagttggattattaatcatccaaataaacagcaggttattttagcaaaattaaatttgataaaaggctgtcgaattaaagtatttagatgtgctagctgtcaaatagagattattaatgaaaaagagttataattcgcttattgaaaagctgtaaaggagagaaactatggtaaatattaagaaaattattaagattatttcttggatcattattgctcttttaggtatagccttgttactaaattggcaaacaattgaatcaccagtcattattcatgctgatttgtcagggaatttctcttatggtaataaatctacacttattgttttctatctaattatagttctaataaacttattatttacatttaaatatgagataccattgatgaaagaattgcataaaatgattaaatcctcgttagtgatagatataattagtatattttttcaatttttgataattgttgttataggagcatttatagttaaagccataatttaaaaagtataattaaatcaagtttccctaataagggaatttttttatgacgtatattcagaaataaagaagactaggttttgttactttgtcgctcatttaaaactacgatttgttcaaaaatactgtcaaattcaggattatccagattagtataaatttcaactttatacttaattggagcgacttcaataaatcgattcattgaatctaaaacgaaactatcaaatttagctaaatcaatgtttgaataagttttattaattttcaatttagcacgaagatactgtgaaataaaatatctaatttgagcaatatgaatttttttcaataaaccaatattatcaaaatagtcaatgctgtgatcaaattcatcaccattatgatcgatcatgtcacataaagtagaaacttcaatgtttaatttagcattaaaaaaaggaatttcttctaaatatgcaatctcatttataagccatattgcttcaaataagctagctttaagttcattattgtctaactcatttaaatcaattagatttgatgtgagctgattcatatagttatagaacttatcaattggatagtatgataaattagataaatcatcatatcttgcataggttagatacaatttgtcacagctaactttataacctctttgaattaattcatcttttttacaaataccaaaatatagatagttacctcttggtaaatcattaatattggggacctgctgtaataagtctaatgaattaaaaaaatcatacatatacataaattttactccttctttgttataagtattaattttgggaaaaatagctacatcaatataataccttactaaatagcaaatatctatatagataattactaaaaggcaatttattatttatacttatttcaaagaggtgatttcaatgaatgaatatggacatataataatgaatatagagcagattttaaaaaataaaggaataagcaaaaataaaatatgcaaagaattggatatacctcgacctaattttaatcgatattgcaaaaattcttttcaaaggatcgatgcaaatcttatttgtaaactatgttattatcttgagtgtaacatagaagaattagttacttatattccgcctcaagaaactaaataaaataaaactacgttatttgaactaaatttcatatataagtatttaatggaaatggtttagtaagacgtagttttttatctttagtatatcaaataatagcaaaatatttattgatttgattacctgattaagcgtaatatataagtataaacgggagagctaaaaatgattataatttcaaatgatacagtatatttaaaaaaggaattcacacaagaaacatatgatcaagcactgatacgggttgatatgaaggggcttgaatgtgactgtggcagcaatggtaaactagttaaaattggctattatcaaaggtattataaaacatccacgcgaaaaatatgtattcaaattcaacgagtgatgtgtaaacattgcggtagaacacatgcgctttttgtagaatgtatggttccttcgtcaatgttactagtaacaactcaaattgaattgttgcgttcatattataatcatagacttgaagaatttttgatggtatatccaaccattgaacgttctaatgctttttatgtagttaaaaattatgaaaaaaaatggtcgaaaattttgaaattaacaggtctttcgttaatggatgaagaaaagaagataataaaagtatttataaaaaaatatcaaatgcaatttatgcagatgagatcatactcaaaaatagtatctcaattacggctaagtgaaaagcttagctaaatttgatcaatacacataatttttatattttaaagggcctaaatttgttatactaatcctgggataaagagaggggagtgagtataatgaattattttgatataaaaaatatattaagatataaattcttagtgaagtacaaggttatctcgggataagggctttaatgcgctcaaaaacagattcaatatgggataaagtttaaagtgaggagataagtgtattagacactaagttattaaaaatgaatagggaatttagtattgtgatcttaccaaaggatcaaatgatagaaaagaatagtagagataaaaatatatttataatgaaacgactatatgaaatatttttatcgataggtgcaccaaatcatttaaacggatttggttatttagtttcagcaataaaacgttcatgcagtgatattgaaattttgacagaaattacaaaagaattatacccaagtgtagcaagagagtattctacaacttcgtcacgggtggaacaatcaatccgacatataatcaaggttatttggtcaaacggtaatcttgtagagttagaaaaaatgtttggttatcgagctaaacatcgaccttgtaattcagaatttatttcaatggtaactgatcgactgttgtcagaatataaaatatataatgagtaatttataaaaagaagttcatataaaacttctttttatctgctttcaaatgcataacgattttttattttgagtttatctgcaattaaagcaataaattcagaatttgttggttttcctttaagagaatctggggcggccctaataatggtattaatttttcttttgtcaccttgattccaactgttttcaattgcatgacgaattgctttttcaactcttgaggctgtcgtactgtattggcgagcaatatttggataaagtctttttgttatttgacctaataattcgatatcagagtataccattaaaatagcagttcttaaatacatgtagcctttcaagtgagccggaatgccaacctgctttagaattgttgtaatattatgttcaagtttaacttcactatgatttgtggactgaagattattgactgcttctatccaaatgttattattgtttgataaatgatcaatcagttcagcagatatttcttcatcttcttctaaaatatatatgtagtattgtttcatattattctccttccaaataatgacaaaaactattatataaagacaatgattttagtaaaaggggaattgttattatttattttcttttagtaaactaggtaataagattcatgtttttctaaaatatttcgccttttttagctaatatttaacgaatatttgctaatactcacgaattttggtaaatatttgattataaatggcaatggtaatgttgaagataaaaatttaagattttaacaagttagataaataaactttatgataaatctataattttaattaattttatcttttcatttatcattagatatgatatattgtatacaatgagaggtgttaattatgaaaacaacaacaaatttacaattacatcaccatcattggattgcctagggttttatcagtttattgatacaacccattttgtgttaaatattatttgggtgtatctaatgacaatattactttagcgagtcattagtgtaatgactcgtttttttgtaactaaagggggaaataaaatggaagaatttaagtatttaataccggaagaaagtattgatgcaattattactaatgtatcgaaattacgagagattgaaaatagtttaagagctatctttgcaaagaataactataatgaagtgttaatgccatcatttgagtatgttgacttatatactcaattagattgtggttttgaacaagaaaaaatgtttcagtacattaatcatgaaggtaaaaatgttgcaatgcgctgtgattttacaattccattagcacgtttctattcaacaaacaattatggtgatgaagaagcacgttattgttattttggtaaagtataccgtaaggaaactatgcataaaggacgttccagtgagttttttcaaggtggagttgagttgatcaacaagcctggaattgctggtgataaagaatgtttaaacatgattcaagagtctttaccacatcttggattaaaaaatattcttgtagaaattggttcagcacgtttttttaatcgcctatgcacactggttggtgataaggcagttgaattaacagaaatattgaagtatcgggatataagtgaaatgaaaaagtttgttgccgataatgaatttgatgggcagttaaatgaactattgttaaaattgccgactgcttttggtgatatcactttattagatactgcaatcaaaggaataaatgatgaaatattgttaaaggctttggaaagattaaaagagttatataactctttggataataaagaaagtatcatttttgatttaggaatggtgccaacaatgaaatactacactggcttaatgattaaaggatatagtgataaaagtgcgcagccaatcatttctgggggaagatatgatgacttattaccaagattcaataaaaatgttggtgcaattggattttgctaccatatgaatcatattttaaaagcgattgataagcagggggaaggcaataatgattaaaatagcaataactaaaggtagaattgaaaagcaggtctgtaagttgttacaagaagcgggatttgatatggaaccaatttttaataaggatcgggaattattaattgcaacaaaagatggaattgaaatgatttttggtaaagccaatgatgtagtaactttcttagaacacggaattgtcgatattggttttgttggtaaagatacattagacgatgttgactttgaagattattatgaattattggatttaaatataggtaaatgttactttgctgtagcggcttatccagagtatcgtaacaagaaatttgaacggcgtaaaaaaattgcaagtaaatatactaaagtagcaaaaaaatattttgcaacaaaacaagaagatgttgaaatcattaaattagaaggatctgtagaattgggaccaatcgtgggaatcagtgacgcaattgtggatattgtagaaacggggtcgactttaaaagcaaatggcttagaagtaattgaaaaaattagtgatatttcaactagattagtggtcaacaaagttagttttaagtttaaaaaagatgaaattatgaatttggttactaaattagaaactgttacggagggaaaataatgttaaagatcgttgattataaaggcaatttagaagcggtagcgactaaattagacagccgtaaggaaagtgttaataaggaagtaaatgaggctgtattaaaaattattgaagatattaatgaacgtggaaataaagcattatatgagtattgtttaaagtttgatggttatcaaattaatgatgaaaaagatttaatcgttagtgagatagaaaaagaagaagcattaaaacaaatagatgcagattatctacgtatccttgaaagaactaaagaacaaattactgaatttcataaaaatcaaattgataaatcatggtctttatttaaagataatggggtaatcatgggacagatggtgcgtccaattgaacgggtggcattatatgttcctgggggaaccgctagttatccttctacagtattaatgaatgctgttccagcaaagttagcgggagttaaagatttagtaattattacaccggtaaaagaagatggaaaagttaatccgattattattgctgcagcaaaagtaagtggggtcgatacaatctataaatttggtggcgctcaaggggtggctgccattgctcatggtactgaaacaataaagaaagccgataaaatcgtaggtcctggaaatattttcgttgcgacggctaaaaaacttagttatggacttgttgatattgatatggttgcaggcccaagtgaggtattggtaattgcagatgagaacgctaatcctaaatatattgctgctgatttaatgagtcaggcagaacacgataaactggctagtgctttattagttacgacaagtcgtgatttagtggctaaagtaaatggtgaattagttcgccaaatggcttatttatcaagaagagatattatcgaagaatccttggttaattatggtggagcaatcattgttgataatttgaatgaagcatttgatgtttccaactatttagcaccagaacatttagaagtattagtagataatcctgtaaatatgttaccaaaaattaaaaatgccggttctattttcttaggagaatattcaccggaaccattaggcgattatatgagtggaactaaccatgtactaccaactggaggaactgctaagttttattcggcattaggggtatatgattttgttaaatattcatcttatagctattatcctaaaaatgtcttaggtgaattcaaggaagatgtaattaaatttgctaaaagtgaaggtttagatgcccatgcaaattcagtagcagtaagatttgaggaggaatagtcatgagaattggaaagattgaacgtgaaacaaaagaaacgaaaattcttgtgcaattagatttagatggagaaggtaaaagtgaaattagtactggaatcggattctttgatcatatgttaacactatttgcttttcatggaggttttgatttaatcgttaaatgcgaaggtgacttagaagttgatactcatcatacagtagaagatcttggaattgctttaggaacttgtttaaaagaagcgcttggcaataaactcgggattaaaagatatggagcttttactattccgatggatgaaacgctagtaacaaccaatttagatattagtgggcgtcctttcttagtttataatgttaatctaacttgtgaaagaattggcacatttgaaacagaaatgacggaagaattttttcgggcattggcatttaattcactgattactttacatattaatgaacagtatggaactaataatcatcatattgttgaagctatatttaaaagtttaggaagagctttaaaagaagcggttagtattgatgaagctaacaaagataaagttgtttcatcaaaaggagtcttataaaaatcaaggggggatttagatggtagtaatcattgactacaatattggtaatttaagtagtgttatttccgctttaaaaagggtcggaattgaagctgtaattactcgtgacaaagatattattcgccaagctaaagcaattgtattacctggagtaggggcttttccggtagctatgaataatttaaaaaagtttgatttaattgatgttttaaatgaacgaaaagatgctggaataccaattctgggaatttgtttgggaatgcaaattttatttgaaaaagggtatgaagttgaagaaactaaaggattaggtttcctagatggagaagtagtctttatggatattgatgaaaaggttcctcatatgggttggaatcaattacatttcaaccaaaaccatccaattttaaaaaatattcatgaaaatgatgatgtctattttgttcattcttttatggcaacatgcccaaatgaacaattaattgcttatagtgattatggtaagacaaatataacggcaattgcggctaaagacaatgtgattggttgccagttccatcctgaaaaaagtggagctgtaggacaaaaaatattattagcgtttaaggagatgatcgaatgttagttattccagcaatagatttaaaagatggtcaagccgttagattgtttaaaggtgattataatcaaaaaacagtatatagtaatgaaccagaaaaattagctgagaattttgagaaaatgggtgctaagctgcttcatgttgttgatttagatggtgctaaagatggtgaatgtattaatcttgaaacaattaagaaaataaaacaaaatacttcaatgcaagtagaacttggtggggggattagaaatattgaaacagttgctttatatttagatgaagtaggaatagatcgggtaattttaggaactgctgcaattaatgatccagagtttttaaaaagtgctattaatacctatggtcctgaaaaaattgtcgtaggagttgatgttaaagatggctttgtttcaacttcaggctggttaaaaatcagtaacgtgccatacttggagtttatcaaagagttagagaagttaggggttaaatacattgttgctacagatattagtaaagatggaacattacaaggtcctaactttgatatgtatgaacagatcgctagaacttctactattaactttgttgtttcagggggcattaaagatgctcaaaatattaaagatgtagctagtaagaactattatgcatgtattgttggtaaggcttattatgagggtaaagtagatctcaaggaggttattacatgcttacaaaacggataataccttgtttggatataaaaaatggtaaagttgtaaaaggaattaattttgtagaattgaaagatgttggagatcccattgaattagctaaacgttatgatcagcaatgtgctgatgaagtagtgtttttagatattactgcaagttatgaagaacgtgatattattaaagatattattgaacgcggggctagtgaattaacgattcctctagctgttggcgggggaatccggacgcttgatgattttcgaacgatcttagctagtggagcagataaagtatctgttaattcggcagctattgcaaaccctgatttaataaaagcggctgctgatgaatttggggtacagtgtgtagtcgttgcaatcgatgctaaaaaacgtgatgatgacggttatgacgtttatgtaaaaggtggtcgtgaaaatactggaattgatctaatagaatgggtaactaaatgtgaagaattgggtgctggggaaattctattgacttcaatggatgcagatgggactaaagcaggttatgatatcgacatgatcaatgctgtatgtaatgctgttgatattccagtaattgccagtggtggttgtggcagtattcaagacattgttgatgtctttaaacaaactaattgtgatgccgctttagtggcttcattatttcattttggcgaagcaactgttgaagatgttcgtaaagaattaaggaaacatgatataaatgtaaggagagcaatgtaatgaaaccagattttacaaaaatggagttgattcctgctattgttcaggactataaaacaaatgaagttttgatgttagcttatgtcaacgaagaagcatatcaaagaatgttagaaacaaatcaaacttgttttttttcaagaagtaggaatgaactatggcataaaggtgaaacatcaggtcattttcaaaatattaaagggatgtatttagattgtgatttagatacactgttaatttttgttgaacaaattggagcagcatgtcacactggagcgtactcttgtttctttaatgaaataatggcttatgataatactaatatttttagaagtctatcaaatctaattgaaaatcggaaacaaaacccagttgaaaaatcatatactaattacttattagatcaaggtgttgataaaatttgtaaaaaagtaggtgaagaagcaagtgaaacgattatcgcggctaaaaatgatgataaggaagaattaatcggtgaaatcagtgatttattttatcatgtttttgttttaatgaataatcaaggggtaacacttgacgatattgaaaataagttaaaagatcgtcataaaataactggaaataagaaagattttcatactaaaggagactattaaaatgcgttccattgactatcatatgcacactagattttcaggtgatagtgaggctgatccgcgtgaacatgtaattcaagcaattaaaatgggactagatgagatttgttttactgatcatcgtgatttcgattacccaattgatgtttttgatctagatgtcgaaggttattatcaaacaattatggctttaaaaaaagaatttgcagataaaattataataaaatggggcattgaaataggtctagatatgaatcatcaattagagattaataatttgattaaccagtatccttttgattttgtaattggctcaattcatgtaattgatcatactgaattttattatggggatttttttaaaaatctaaataaagagcaagctcatcaggctttctttgaagaaacgctaaggtgcgttaaaaattttgactgttttaatgttttaggacatttagattacattatgcgatacgggccttatgaagataaaaaagttgaacataagaaatatcagaatataattgatgaaatatttaaaaatttgattattaaaaataaggggattgaggtaaatacttctggatatgcagttaatcagacttgcggctttccaaattttgaacaagttcaacgttattatgatttaggaggtcgtattattactattggtacagatagtcatacaagtgatcgagttggtcagtatgtcaatgacgttaaagaaaatttaattaaaatcggctttgaggatgttagtacatttacagggcgtttaaaggattagatagcaaaaatctaatctttttaatttattatcataatcattaatcatttatggtataatggataatatatttggaggtaaaaatatggaattatacaacaaggaaacattaaaagcattgaaagaaagtgtcgatgatagtacttattatctgccaaaagctttatttcaaggcagtaaatttggaaatattcgtttagaaacaaaactagcatatgctgctttactagatacattattaagaaagcctgtttttaatcaagaaaatattgctttgttaaaaatagataatccagtaattgctcaaactttggcagcgatggcaaataaagaggtaaatcaggcaaaagtagctaaatacctagatgaactaatagaagctaatttaatcgagattaataaacaagacatttatatttatcatattgattaatgtttaaatttatatctaaaaaaatcattaagaattataatgattataataaccctaaagtaagagaacagtatggcatgctttgttcaatcgtttcgattgcctgcaatattgttttagtaatttttaaacttacaatgggggctattactcatagtattgccattcaggctgatgggttgaataacctttcagatgttggtagtaatttagcttcattatttggttttaaattagctaatcgtcatcctgattcagagcatccttatggtcatggtagaattgaatatgtagctggtctaataatcgcttttttaattttattagttggttttcaagctttaaaagattctatttttaagatcattgctcctgaaaaagtaacttttacaatcgtagctgtagttattttaattgtttcaattttaattaaattatggatggcaatgtttaatcgaacggtttctaaaaatattaattctgctaccttaatggctgccagtcaagatagtttaaacgatgtgatggcgacatcagcgactttaatttcattaattttatccctttatactgatttaccagtagatgggataatgggagctgttgtatcaattattgttttaaaagcaggaattgatatctttaaagatactgttgatcctttattggggatggcacctgataaggaattgattaatgaaatcgaagaatatattctttcttatccagaagctttaggaatccatgatttaatgatgcacgattatggaccgggtagaaaatttttaactttgcatgttgaagttgattgtaatgataatattatggcagttcatgatgcgatggacttgattgagcgttcaatgttggagaaatatcatatcctgacaacgattcatatggatccagtagacacaaatgatgctctaacaaatgaattaaaacaagtagtcttaggagttgtcaaaggaattaacaaagaatacagtattcacgattttagaattgttactggaccaacacatacaaatttaatttttgacgttatgattccttcaaatgatgaaattaaacataaagttttaaaagaagaaatcaatacgaaactacgtgcaattaaccctaattactatacggttatgcaaattgaacatagttttatttaaaaaagagccactgcagtttatctgcagcggctctttatgctctaaagattacctcttctttttcatacatcattttagctgcaatcattgaaacaattacataaacgattgaccagccaattgtcatatatagatgaacataatttaattgattgaatataatttctttaataacgattacaacattgagaattgggatattcatcatcgccattgaaactgaacttggctccatatacattgtaattactgaaagtaacaccggaataagggttacaggagttaaatacgtattagcttcttttaaagaacgagcatatgttgaaactaataacatcactgcagaaataaagattacatataatactgctaataatacgattaacagcatgctttgaagtgataaatcgatagtgatggccatcgtatcactcattccaaatttaaaagcaagcagtaaaccgactgctgataaaattgaagtaatgctaccaaaagttgcagtgacaatcagtttaccaattaaaatagaacttctagaaatacttgttgaaagtaatggttctaaagttccccgttctttttcaccagcacctaaatcggttgcaataggtacgattcctgaaccagaataaccaatgatcatcataggaattaacattcctagcatcattaaggacatactatcagcttcttcgtctttagcatgttcattataagtaaatggttgtaaaactttacttgataaatgatttgcttctaaatatgatgctaaataactattttgataagtactgaacattgtttgaacagtacttatagcagtcattgcacgttgcgaggttgtatcataatataggtcaacttcaggtgtacttccttgtgttaatgattcattaatatcattagcgatgatgtaagctacgattttcccatcataagcttcgttaatagggtctttgctattaacaagttcgtaaatacccgcttctttaaaaagagcagtgatttccggattatttgtttctaaaacaattttatatttattatcttcgcttggtgatgccatatcaccaattgatgaaaagataaaggtaaacaataggggcatgactatgattgggataacgaaagtcattagtaatgttttacgatcgcgtaaaatatctttaaattctttttttacaattgtcataatattattcatgatcattacctccaatacattcaataaataaatcctcaagattatcttgttgatattccttttttaattgttcaatcgtgccgctggcaacaatttttcctttatgaattatgataacgcgatcacatagtttttcagtttcatacatattatgactagaaaaaacaatagctttattttcttgcttacattttaagataaagtcatgaattaatttacttgataaaacatctaatcctgtagttggttcatcaaataacataacatcaggatgatgaatgatacttcttgctaatgatactttctgtttcatcccccgactatacttaccaacaggacgatcaatatattctaccatttctaaatcttgagcaatttgatcaactgcttgtttagcttcttgatcactcatcccgtttagtttagcaaaatatgtcatattttctcgtcctgataaacgatcatataaagcaacatcaccaccaaataaaataccgatatgttctctaattttactaggattatcaataatattataattatcaatataagcgttaccgctagttggctttaacattgttgctaccattcttaatgttgttgttttaccggctccattttctcctaatagaccgataatttctccagcgttgacctcgaaagatacattttcaacagcattaatttttttaaatgtctttgttaagttttctacttttaacatgttcttcccctccattaattatcatcatcttgatgataatggttataaattactttgattacataggtgataaagataatgatgtaaaaggaagtgaaaattagttcacagcctaatacggataattgattgtctatgattaaaggttttccattgataattaaaaatagatataaaccaaaaaaaccaaatccataaagaccaaaaaatataaataataaacgataccgggcctttgttagaggatatatttcatagtagatcattaaaataaaacaataagtaatactaatgaacaaagcaattaaatattcccaatcaccaatcattaggtcaatattaaatatctctttaataaaaaatattgcaataataataaaactcaatactgaaaaactcttaaaatagatatttcctctaattttcaattgtcgttcatcgagtcggcatttaaataatgacttaaatttcttcatcaagaatatcctcccaaaataattcatccaacgatttatttaaaactttacaaattttaatacaaagtttaactgttggattataatctcctttttcaatcgcattcattgtttgacgtgataccccaacagcatctgctaaatctttttgggtcatatccagtgcagctcgagctgcttttatccttagatttttagccatctcatcacctcaagataatagtagtgtatattttaataaatgtcaaatatatattacattttgtaattaatatttatgattataatataaatataaacatcctcggattataatgataatgaaaatacaagctacgattccaagcaataagtcaaaactgtagagtggggcaatcacagaaaccaatgccattgtaataatctcaaaggtaaaagaaaaatttcccccaaccttgtcagcaataaataatttacgttcatcatgatcatttatatatttttcaattaactttacttcatttttagctaaaaagaagttagaaattagattaatgcacggaaaaacaaataaagcaaaagaaagtcctgtttgatatccatgtacaaagtcaatgtaatgttcgttatttgaattaatagttaaaacattagttaaggacaagatgattaaagttaaagcagatatcattaaagtaatcatccagtaattagtttttttcaagtcttcacgtgctagaacaattcttttatccattatttagttcctcctcaaaatcaaatatttcttcaattgtcaagttaaaatattttgcaattttataagctaaaattaatgaagctgtgtatttgcctacttcaattgaagtaattgtctgtcgggttaccccgacagaccttgctagttcttcttgagaaattttataggcttttctaagttcaggaattttagttttcattataacactcctatctttgcaaagtacgctttacaattaaagtatagtttgctttgcaatatatgtcaagctaactttgcaaaataaaaacctgctaaagattaaaattctttaacaggatatttttcagcattttttataagttttttttcaataattgtacttacatcaagatttagtgagtatgccagctgaaaacaatatatcattacatcggcaagttcttcactaatattttctgttttgtaatcattatcccactgaatacattcaagtaattccccagcttcaatagaaatacttttaattagacattcgggatgttctaattgatcccaaccacgtttttgaacaaattcaataattttattttcaagctctttcataaacatctccttttttataattatatgaactattgatagataatcaagtaaaatgaataaatgtcgatacaaacgggaataaatttagatataaaaaagacaggaaaataatgcatagtaaaaaagtaggaaataattaaaaaatactcttgacttttaaaatagatttagttaatatattgccaacgacaatgaaaagaagagtagttcacttgaactttatagagaatccttggatggtggaaaaggataggggataatgaatgaagatggtcttggagtcttgtaggcgatatttagcctatgacgggtgtgcccgttagcgcactagagtatgattgtactcgaagaggttattgctgtgaggtaataatgaattaaggtggtaacacgggcaatgctcgtcctttggcttaaaggacgagtttttatattttaaggaggattttatgattgaaattaagcgcgttagtaaagtttatcgattaaaggatcgtgaagtagttgctgtagatgatgtttctttaactatcgaagatggcgatatttatggaataattggttatagcggagctggtaaatctacattagtgcgtctaattaaccaattagaggtacaagatagtggtaaaatatttattgatggacaagatttagggaatttatcacaaatagaattaagaaaattgagaactaaagtaggaatgatttttcagcattttaatttattgtggtcacgaacagtaagtgaaaatattgaattagctttagaaattgctggtaataaagataaaaggattcgtcagcaaaaggttcaagaactagtagagctagttggtttaacaggtcgtgagaatgcttatcctagcgaattatcaggtggacaaaagcaacgggtggggatcgcgcgagctcttgctaatgatcctagaatcttattatgcgatgaggctactagtgcattagatcccgatacgacaaaatcgattttagaattattattaaaaataaataagaaattaaatattacgatcattatgatcacacatcaaatggaagtagtccaaaggatctgtaatcatattgcagttatgtcagaaggaaaagttatcgaagaaggaactgttaaagagatttttacttcgccgcaacattcagtaactaaaagttttattcaagaaggaaaaaatcataatgaatttgatgagactgttctaaagaaaatttattctaaaggacgattattgaaagtagtgtttgatgaaaatgttagtcgtttgccaattttgactaaagtaattagagaatgtgatagtgatataaatgtaattgaagctaatttaagcaatactatcgatagttcatttgggattatgattttgcaagtaatcggtgattatgaaaaagtaataactttatttgaaaaatatttagctaaagtggaggtgatgtagatgcgaagtattttagaaaacattgatatcaatgcgatgatagcagctctaaatgaaacgctctttatgacattgatttcattgatttttgcggtaattcttggaatggtcttgggaattgctatatatttaactcaagatgatggactgtatcctaatttgatcgttaataaaattttaaatttgatcgttaatgtatttagagcggtaccatatattattttagtatttttgctaattccattgactacatttttggttggttcaatgttaggtgctaaggcagcattaccgtcattgattttatcaagtgcaccattttatggacggatggtcatgattgctttaaatgaagttgatggtggaacgattgaagcaagtaaagcaatgggggcaagtaatgttcaaatcattactaaggttttaattccagaagctaaaccagctttgatttcttcgattacagttatgtccatttcattagttggttatacagcaatggcaggtgccataggagctggtggtcttgggaatctggcatatctatatgggtttgtaagaactaacaattatgtaatgtatacagccacatttttaattttagttattgtttttattattcaatttattggtgattattttgtaaggaaaatagataaaaggtagggaaatattatgaaaaaattatttatcggaattattagtttattattagcagttacactaactgcatgtggtggaaaaacagaacgtgatgataaaacattattagtggctgcaacctcaaagccacatggtgatattttggaagaagctaagaacattttaaaggatgattatgatattgatctagagataaaaattttagatgactattatatttttaatcgctctttaaatgatagtgatgtagatgcaaactttttccaacatgtcccattttttgaaaaggatattaaggataataaatatgatctagttaatgctggtggagtgcatattgaaccatttggtttttattcaaaacaaattaaaaatattaatgaattaaagaaaaatgatattgttgttatttctaattctgttgctgatcatggacgaattctagctattttagatgaagcagggatcattgaattagatgataaagtgaaagtgcaagatgcaacgattgaagatattaagactaatcgattaaatttggaattcaaggaaattaaaccagaattgctaactaatgcgtataaaaatgatgaaggtgcattaatcgcaatcaatgggaattatgcaattgatgctggcttgaatccaactaaagatgcgattcttttagaatcagcagatgaaagtaatccatatgttaatatcgtggcgtgtcaaaagggacatgaaaatgataaaaaaatcaaagctttagtagcagtattacaatctcaaaaaattaaagattttattaccaatacgtatagtgatggatcagtgattccggttaaataaagatgcttaggcatctttttttattatggcgattgcgtagatacagaaaataacatataatttttaaagttaggaggttttaccaatgttatgtagagattatttgtatcaagaagtagaggttctcattgatcgtccattaggttctcagcatcctcaatacggcttcatatatcctcttaattatggtttcattgaaaacacagttagcggagatggagaagaacttgatgcttatttgcttggtgtctttgagccggtagaaagatatcgtggggtagttattgcagttatccagcggactaatgataatgatgataaattgattgttgttcctcataatgttgattatagtgatgaacagattagagccttaacagagtttcaagagagatatttcaattcagttattctaagataaaggagaagatgatgactataacagtagacgaatatattaatagtttttaccaacagatacaaataaatttaattaagttaagaaaaataattaaagaaacggcgcctgaagctcaagaaaaaatattatggggtgtaccaacatattttcaagacggttttctagtccagtttgcagcatataaaaaacatatcggcttctatacatcaccgcaaacaatagaagcttttaaaacagaattagctaattataagacaaataataaaaatacagtgcaatttatgtttgaacaagaattaccagtagaattaataaaaaagatggttttatttaaaatagaggagaacactaaatgaggctaggaacaacatatattagtgtcaatgattttgctaagtcactggctttttatcagcttttattggagcaagaaccattatattgtaatgatgatcggtgggctacatttgattgtgggaattcattatcattatataatcgacaatttgatattgattttcttgtaaataacgattatcgtggccattataatcattcatatttgacaactttgaaaaatgaaaatagtgataaaataaatacatcagttatattcaattttgaagtagaggatttaataagtgaatatgaacgaattaaaaaattaaagataggggctgtatctgaactgttatttgtcaatatccatatgccatactggtattttacaatcaaagatccagatggtaatgaaattgaaattactggcaattataatggaagcgacaagctaacagatgagtaaatttttatcttttcatattcagtaaataaaaaataattatattaaaatatgataggataaaacagttggaggttttaataatgaaacgtaaatttttcttttttgatattgatggtactttggcagttgggacaccaggaaatcaatatgtaccagaatcgactaaaatagctatttcaaaattaaaagaggctggtcattttgttgctattgctactggaaggagttatgcgatggcagtagaacatatgaaagaactagggtttgaaaatatggtaagtgacggtggaaatggaattacaatacataataaattagtagaaattaaacccttagattacgataaatgtatcaatttaattaatgaatgtaaggaaaaaggatatatttgggcaatttcacctgataatgcgacaagacgattggcaccagataatcgcttttatgattttacacatgatatctatatggataccatagttcaagaaggtttggatccaaaagactttgataaaatttataaagtatatgtggcttgttatgctccagaggaagaaaagctggaaactttaaaggaactgccttggtgtcgttttcatcaagaatacttgtttgtagaacctggcgataagtcagttggaatcaaaatgatggttgatcattttgatggggattatagtgatgtagttgtttttggtgatgaaaaaaatgatttgagtatgtttactgatgaatggactagtatcgcaatgggaaatgcaattgatgctttgaaagctaaagctgcatatattacagatgattgtgacaaagacggtatttataatgcctgtaaacattttggctggatcgactaatatgtccgttaatcgactatttgaaactatttattatctgatcgaacataagcagactactgctaaagaattggctgaacactttgaagtttcaacccggacaatatatcgtgatttagatcgcttgatcgtagctggatttccaatttatgccaatcaaggagctaagggtggaatttatatagatagtgaatttgttttggataaaatgacattcagtgatgatgaacagaatcaaattttaatggcacttcaatgtatagagaggcttcaagatagagatgaagcaggcttaattgataagatggcagcgttatttaataaaaataaactagattggattgaagttgattttactacttggcatcataacaatagtcaaaatgaaaagtttgaaacaataaaaaaagctatttttgaacaaaaggaaattaaatttaaatatattaattcttatggtgagaaatcacagcgatgtgtttttccaaataaactgttttttaaagcaaatacttggtatttacaaggatattgtcttcaaaaaaatagctatcgtgtttttcggctaacaagaattatagaattactaacgacatcaaattattttcaacttgaagaaattgctttaccaccaaaaataaataaaattcctaatttgaatacctcgaggattaaagtgattttaaaatttgataaaagtatagggagtgttgtttttgatgaattcggtgatggtgtaatctgtgaggatactgctggaaattatatagtaagtagtgttgtccctgatgattactggttgattagttttattctctcatttggatctaaagttgaggtaatagaacctcaagaccttaaagataaggtaattatagaaattaataaaattaaggctgtttataaacaaacttgacagaggatgtcaagtttgttttgttataatgattctatagaaaggatgagttaaatggaaataatcacagtcgatcaaaataatttggagaaggagcatatttgttgtgcaatttctagtaataatgatatccaagttaaagctaaaaaagcttggcttgaggaacagtttaaatgcggattgatttttaaaaagatggatgtaaggggaaagtgttttattgaatatttaccacttgaagaagcttgggtacctatcgtaggtgatgatcttatgcatattaattgtctttgggtatctggaaaatatcaaggacagggattagctaaaaaattgttggaagcttgtattgaagattgtcgtaaacagaagaaacatggaataactgttatttctgcaaaaaggaaaatgccgtttgtaatggattataaatttttaattaagcatggttttatttcaataatgagtctagataaatatgaattaatgtatttaagtttagattctcaagcagttcaaccaagttttacgattaaagaaatgacttgtgaggaaggtggattagttttatattatagtcatcagtgtccttttacagctaaatatgccccgatgattgaagcgtattgtcaagaaaaaggtttaataattaaattaaaactattaaatagtagtgaggaagcaaaaaatgcgggaattctttttaccacatatagtttgttttataatcataaatttattacaagagaaattttatcggttaaaaaatttgagaaaatattggaggaattaatatgactaaattagattataagaaagaatataaagatttatatttaccaaaaaggtccccaatgttgattaatgtagataaaatcacgtatgtaacagttgatggtaaaggtaatcctaatacatcagctgaatataaagaggctctagaattattatatggtatttcttttacaattaaaatgtccaaaatgacggataataaaatagatggctattttgaatatgtagttccccctttggaaggcttatggtggctggataaaaaaccaactgaaaaagtaatcggtgataaaagtaaattttattggaaatcaatgattagattacctgaatttgttacacttgaagtttttgaacatgctaaagaattattaaaagtaaaaaaaccatacttaaatcttgataaagtaaattacgaaattattgaagaagggaaatgtgttcaaattatgcatctaggcagttatgatgaagaaaatacgagtattgaaaaaatatatcaatttatcgaaactcaaggattacaaattgatctcaatgaagtccgccgacatcatgaaatttatttaagtgatccaagaaaatgtaaacctgaaaatttaaaaacagtaatacgttatcctgttaaataaaaatacgttatcataatagagggtttgtagtataattatgataaatagaaaggcgggatataaatgcaacgaacattagaagaaattactcagtatattgatcatacattattaaagccatatgcgtcaaaagaagcgatgcaagctttttgtaatgaggcaaaagaattaaaggtaaagatggtcgcaataaattcttactatactaaattttgtaaagaattattaaaagacaccacaatccatgttggcgcagctatttcttttcctttaggtcaaacaacaatagcagtcaaagcttttgaaactattgaggcaatcaaagatggtgctgacgagattgattatgttttaaatcttgctaaagttaaagacggtgattttacttatatcaaggaagagatggaaacaattgttaagatttgccgtgaggcaggaatcattagtaaagtaatttttgaaaattgttatttaacaaaagatgaaatcaggaaatgtgcacaaactgctaaagaagttaaaccggattttatcaagacttctactggctttggaacaagtggagctttgatcgaagatgtgaaaataatgttagaaactgtagatggtgtttgtaaagtcaaagcagcaggcgggattagggattataaaacttttaatgaatttataaatttgggagttgaacgaattgggacaagttcgactaaaacaattattaaagaatttaaggaaaatgatgagtaatctaggtcactagattactttttttgcatataataacctaggtgataatatggaagagtatcaaaaaacggtaatgcgtgtttcaacagttacattattaggaaatttaattttagcattttttaaaatcttaattgggtttatatctttttctaatgcaattatttccgatggtatccatactgcgtcagatgttttaagtacagttgtagttatggttggcgtaaaattatccagtaaagaaagtgatttagaacatccatatggtcatgaacggtttgaatgtgtggcagcaattattcttgcagttatgttgtttttaacggcgttgttgataggatatagcggtattatagaaattattaacccaagtaatgttaaattaaaatatggatcgttagctattgttatagctgtaatatcgattgtggctaaggaagcgatgtattggtatacgattattgaagcaaaacgtatcaattcaaatgcaatgaaagcagatgcctggcatcatcgaagtgatgctttttcttcaattggcagtttagtcggcgttattggtttttatttaggatattatattttagatgcaattgctagtattctcatttgtggttttattctaaaggtagcaatcgagatttttaatgatgcgattgatcaaatgattgatcatgcctgtagtagagaatttcaagaggatttgatttctttaattacggagcaaagtgaaataattaatattgatgatttgaaaacaagattatttggtaataaagtatatgtagatttagaagtacaggttgatggaaatgataatttacgtcatgctcatgctattgctcatcaagtgcatgatttgattgaaaataattttccaacagtcaaacattgtaatgttcatgttaatcctagtgacagttgacaaagagtttacatcttctaaggcaagtgctaaactatagtagttgtaaataatagggggtaaaacatgaaaattgcagtatataattatcgagaatttgatgagggacaatattttgaaaagttttcacaacattattgtgttgaaataattaaaatatatgattcaccaaataaagaaaatgcagttttagcaaaaggttgtaacggggtaagtgttattactacagcaatcactaaggaaattattgagatttggcatgaacaaggtgtaaaacatatttcaacaagaactattggttatgatcatattgacttgaaagcagctaaggcgaataagatgatcgtaagtaatgtaacctattcgactgccagcgttgcaaattatacagtaatgataatgttaatggctttaagaaaaatgaagatgatcatgcgtcgagcaattggatttgattattcattaaacgggagtattggattagaacttgaaaatatggttgttggggtgataggaacaggtgctataggtcaaaaagtgattaaaaatctaagtggttttggctgtcagatacttgcttatgacccatttgaaaaagaagaagtaagaaaatatgcagattatgtggcaatggaagaaattattactaagagcgatatcataacatttcatgttccggctttagaagatacgtatcatcttgtttgtcaagaaactattgaaaaaatgaaggatggtgtcattataattaataccgctcgtggaagtattatcgataccagtgatttgattagtgcgttagagagcggtaaaatcgctgcctgtgctttagatgtaatcgaaaatgaattaggattatattataatgattataaatacaaagtgattggaaaccatgaattatctatattacgagatatgcccaatgttttattaactccacatatggccttttatacagaacaagcagtcagtgatatggttgaacattcgattgaaagtattgtagctgatcgtgatggtaaagaaaataaatttagagtatgttaagatagttttatagttataaattttagataaatattattttcaataatgttataagcttaaaaatatttagctacatactttttaacaataagtagttagaaagttatgaataagttagaaatgtagtattaatttatttattggagacaaactattatggggtgataatagtgaagaataagaaaaaacaaaataagtcaaatgaagcagtaaaaacagctggtaataatcaatggacaaataataataccaaatattatcctgatgaacgcgagcgtcaagatggtcccggaggcaattaataaaaacaagttggttaacatatgttaattcaacttgttttttatagatttacttataagaaaggaatataataaaaaaagtagaaagctctacttttaaatgcatggctagggtacttggattcgaaccaaggaaatgtcagattcagagtctgatgccttaccgcttggctataccctaattagtggacatttataattttaaaactttattggaaaaaatacaaggggatggaatgaaatttatgaaaattagaacaagatttgcacctagtccaactggttatatgcacataggtaacttacgaacagctttgtatggttatttgattgctaaaaaagacgatggtgattttattttgaggattgaagatacagatcaagcccgggaagtagctggggcaatagatgtaatttatcaaacattatcagatactggacttgaatatgatgaaggacctgataaagatggcggatatggaccatatattcaatcacaaagattagaaatttaccaaaagtacgctcatgagcttgttaagctgaatggagctcactactgtttttgtaatcaagaaaatgttaagggtaataaagaggatcaaatatttaaagatccatgtcatcaattatctgatgaagaaatagagaaactattgtcagaaaataaaccgtatgttatcagacaaacaattaagcaggggcaaacaacttttaatgatgaagtatacggagaaataactgtcgataatgatactttagatgagggggtgttactaaagagtgatggttatccaacatacaattttgctaatatcatcgatgatcatttgatgagtataacccatgtagtacgaggaaatgaatatttagctagtacgccgaaatataatataatttatcaaacttttaattgggaaattccaacgtacattcatgttccgccagtgatgaaagatgaacagcataagctatcaaagcgcaatggagatgcttcatatcaagatttaattaagcaaggatacctaaatgaagcagtcattaattatattgctttattagggtgggctccagaaggtgaggaagagattttttctttatccgaactgattaaaaattttgatattaaaagaatatcaaaggcaccagcaatttttgatctcgataaattaaagtggatgaatggactttatttacgaaatttaacgttagaaaattttcatcaactagcaatgccgtattatcaaaaaataattacacgcgatgttgatttattagaactgagccaagtactacaattgaggatttcctatttaaatgaaataccggagatgattgattttattaatgaaccatgtaatgctgatgaaacattatttaaaaataaaaagatgaaaacaaatcctgaaaactcattagaagctcttatttgggttagagatgctttaagtacttttgataattttaatgatgatctagcgttacatgatttatttattaatttagctcaagaaaaagaagtgaagaatggacggattatgtatcctgtcagagttgctttgacttttaagtcatttactccgggcggagctgttgaaattgcacatattttagggaaaaatgaatcacttaaaagaatcgatctggccattaagttattaagtatgaaataatttgatacttaaattgaaatagtattttgaatatacataaaagccttttttacaggaattttgtttctattaaaaaggcttttaaaagtggcatatattactgttttattagctctgattgctttaaagttggtacttattattataaattttatatctgatttttgattatccgcataaacactatactttcaaacattttgaagtatagaaaactattcattttaccacgaatttaccacgattgaatgagccttgatatgacacaaaaacaacatgggagatagcacaaatatctgtgtatctcccgtttttcattcatgtagtatgattattttactctgatttcaaatttcaagattgctttcatcatttctgtatggatttgaccttttaattcttcatcaacctgcataatgattttaccactttcagagtggtaaaacggacgcaagcataatttacatatataagcgtcataaaacttcaaaatctctcttatggcagtttcatttccagcagacgcttgacatattacttttaatgtagggtagccatattcttttttcattggttcaattcctttctttcaatactgtttttagtttcttcaatccgttacttcttctgcgataaatagcagaacgtgatacatgatataattcggctatttcttggtcgctcatactttgaaaatagcgtaatagaattacatcacgctctttattcgataacttatataaagcaacagcaagtttctcatttgatatttgaattgtaaaattcaagacttcaaacgaaatgtaatcacaagaatagttatccttagttacacattcaacatttttcgtatctgataattcacagaataaaacttcacgcttagaacgtcttgcaaactgtctgtttctgttttttactgtgcatttaataacagtcatcatcaaagcattaaactgtattctaacgatatgctcgaaagaagatgggttcataatctcacctcctttccgcatacgctgaaatatataaacggagataccgtctatatctttggaaaatacaaaaagaagaacaagaaaaaagtccgtacaaaatataccgtctgtacgaacttttaatattgtaaaatatttagttgttgataaaatgctgttaggtagtgcataatcgtataagattattcctaaaactttccacagcagttactttcaatgcttttatatcttgcttttttagtcctatcataaagttttccatataaccgcttaataatttgattacttgttaaaatagttataatgcaggcgactatgtgactgattaaaatcgctatccaaacaccatttaaattttctgccagccaagataatagataggcaaaaggaatacgaataataatatagtagaatatcattagtatcatactttttgttggttttcctataccatttaaagtacctaagtagcaactagtaatagtgtaaagaacataaccgatactaacaattaaaaaataatggctgacaacatttgttacagctacgttggaaacaaacaattttgccaactgtttagagaagaaaataacaactgctgataatacacttgaaacaacaataccatattttaacgccaatttcagataattctttgctctgtcgatacgttgtgctccaatacattgccctacgattgaagtcaacaccatattaagagccatagcaggataaaataatatcatttctaattttccagcaactccgtagccagcaatagcagaaatactataagtactaacaatagcagttaaaaatgttgtactaatagcaggaatactttgttgaatgacagacggcacagcattttttacaaacggcataatctcttttgtatcaaaatcagatagtgaaaggttaaataattttttacgataaatataaatgcacataaacgccaaacaaataatctgtgatattaaggttgcgattgccgctccgtgaaatccaattatgttaatgaaaataggatctaaaatagcattcaataaagtagacacaagcattgcaactgcttgaaacatagtattgccaaaacttcttaaaatggctgtaaagtataaatacaaataaactgctacatatcccaaagcatatatagataagtaattttttgccatatcaaaaatttcagtcggtgtatttaaaactatcaaaataggctctaaaaaaatctccaacacaattgtcataaacactgaaagaattatagatacaaaaaaagaagtaactataatattctttttcttttgctcatttttcgcaccaattacctgtgataatagaatggctaacccgtttgttgctcccataccaattgaagttaagattaaaataataggtgtcgagtttgttaacgctgcgtatgcctgctcacctaacaaatttccaatccaaagactgtctacgagattatatgccatatttaaaaacatagctattatcataggaacagtcatttcaagtaaacatttttttgtgtttccgtttacaaaatcaatatttttgttcattttaattcctcctattgaatgaaaattattcatttaatttatttaaatattccctgccttttggcaggggaagatttaaagcctaaacaagtccctaaaaaatgcctttatccgtgaactcttttctttaattgatatatcggtatttaaaataattcctagttgtccatatatgcaaaaactggcatacatttcaacatcattgacttgtatttcatttgtgtaatttgctctttcaataatttcagatacaataggaaaaagtttttcacatacattcaatgttaataaattatggaaatttttattttggttattatgaaaaactggataatatgtatcatcttcttgttctgcaaaaagtatcatcttccgcaaaatatcttttaaactatccttttttatatttatattttttgtcatattggcgactaaaatatttgaatattcattgatagcagactgaaaaagtacatcttttgatgggaaatatctataacataatccttgtgctattccaatttcttttgctatgtctgatattgaagttttttcaaacccatttacactaaataatttaatggctgtttctaaaatttcttgtttacgttcctctggttcttttgaaatacgcattgttttctttcctttcttgcggtttaattattgtatgctataattaaacaagatcttgtgccaaaagatttccattcaatttcgtggaagtcttttgataataataacaacatttccttttttgaataaatctttacatctccactattgctgtgtttcatatagtaattcattatctgtcttgctccgattggttgccaacaatcaccgataatgaaaactccattttgctttaaacacctagacacttctttctctacaatatctggttgtggataatgatgaaatgagtcattacatacaatggcgtcaaaagaactatcttcaaaaggtaatctctcagagtcgcctaagataagtgttgcatcatttcctagtttattttttgcaatttcaagcatattgggagatatatctattccaaatagttgttctgctatatttaattcttttatttctttaagtaacgcacccgttccacaacctaaatctaatatagaatgtatattcttattttttaaattttctataatcggcttatagagttttcgagcatgttccccctgaatatttgtatcataatcggcagcttgcttatcaaaagtcttttgtgatttttgtttcgtaatattcatgtaatcaactcctttcactaaaattatatctcgtgaatgaacgattgtcaatgaataaaattcattgacaatcgttcatttcaaagacgtgtatctctgatttaaaatacacgcctttttgattaccctacaatcttccagttactattccttatatagcccaaatttgtaccgtgacaatttcattgatattatccgatttaccacaaatcaaattttatcttttcttcctcttgattaccctccacagaaaagaaaaagccctgtcaagagccttgccaccattggtggtgctttgcactctttactgggctttttgtttgctgtatcttctacaaagagggaaaaagttattcgtcctcatcatcaaaatggttatttttcaatacttcccgtaataattccatatcttcttttgaattggggtttatcatttttacgacttgataaggtgtcctatatttatgtccctctatgctttccccgaacatatccatgctgtataaatcatcatagcggtctaacagtttttgaaacttcaaatgctggataaattctttgattggataaaggtcggacgctacaatacttttcccgttgatgtagtcggtaatatattcccgtaacttttccaactcatattccagccattcttcctcgctgtcaaagaagttgtcataatgtccatgttttagttctgcatttaatcgttcttcaattcttaaaaactggcagacttccttttcggattgattaacatacttccattctcccgataataattcattgggcattacacccagcacgtccattatcttttctaatgtatcgaaggtaggaaaattcacacctcgttcaatcttggaaaggctctgcatattgataccgattttatccgcaagttcctgttgtttcattcctctgtgttttcttatggtctgtatgttctctcctaagaaactgattttcttttcgtaatgctccataacttagtataaccgctcctttcgttgcttttcttggtatttataagcatatcatacttaatctacatctaaaagtcaacaaaaacttcttgacaagtaattctaatggcgttattatcgtatcagatagagtgattaagcacgataaggtcaatcacacgcttgagtaagcatagagaagatacattttcactttgatagcatgaataagcatggactatcagaccgaaaatagtggtttccaaaaggggctggctggacggggcacgtcccccagacgtgttcggacagacagttccttttggaaaaggaacgcctaaaggcgttcgcagagggcgtatatgtaacaccgccctgcgtatacatgtcatagtacctagaaactgtgataaataaagagaaagatgcaatttataccccgcaaaaaatcggggcatacgaaaggagtaatgaagtatcgcaacacacgaaaatttatccgttaagattgattacatcagcattgtatttgatactgcaaccgcagaagatgttatcatgcacattttaggtttaccgactgacatttttaatgtctatccggcaactgttaaatttaagacttatcaagcacgctggcagattggagatatttatgtatcgggcgacgcaagaaagacagaggacaccccacaagggttaggctgttatctcgttatgactggcagaggttgtgatgatattttccgtattcttgacagtaggaattatacctttggggatatgttcaaacattgtgaaagaagatacggactggataacttccacttcacaaggcttgatattgccattgatgataagaacgaaaagccattctttaccatagagcagataaagaaaaaatgcgaaaaagaggaatttatctccaatagtgagggctaccactttgatgaaagcaagtttgacgatttcgacaccgcaaaaactgtttatatcggtgctggaaaatcgggattgtcctaccgcttttatgacaaggataaggaagtctgttcaaaatataataagacgcttgatgaagtcggcagttggaaacggacagaaatgcaactgcgtgatgataaggctcatgcctttgccatgacatttaaggacagaccgctggaacttggggaactggctttcggactattggcaaacaacctacgctttgtcgtagcaaacagaaatgagagtaataagagcaggtggaaaacgtatcggttttgggaacgctttttaggggctgtggaagtcttgaaactgcaagtacccaaactgcataattcccttgaagaaacacagcaatggctcacagagggtggcgttatttccgctgtcaaaagtttttacttcttggaagaacatgacgcattaggtggattggaacgagtgggaactatgcttgacaaggcaagatacagcacttctctttccagcaaactgaccgctcatttacagaggatagaccgcaccgaccttattccttatatccaatatgatacgaaacatgggaaagggggtatctgatgaataacaacgctattcccgtatgggaaaaatacacccttaccattgaagaagcgtctaagtatttccgtatcggagaaaacaagttaagacgcttggcagaggaaaacaaggacgctggctggctcattatgaatggcaaccgcatacagattaaacgccgacagtttgaacaggtcattgacaaattggacgctatctagtgcaaatgagccttgtatgtgttatgatgaacacaagtcatatcaaggctctttccaacaaggaaaggagcagacaccatgaaagaaaaaagacgggataacaaaggacgtatcctgcatactggagagagccaacgaacagacgggaaatacttatataaatatgtggacgcatttggaaacacaaaatatgtgtatgcttggagattgacacccacagacccgacaccaaagggaaaacgggaaaaaccctcacttcgagaactggaacagcagataagacgagatattgaggacggtatcgacagcacaggcaagaaaatgacgctttgccaactttacgccaaacagaacacacagagggcaaacgtgaagaaaagcacacagaaacaacgggaacagctcatgcggttattgaaagaggacaagttgggtgctaggagcattgatacaatcaaaccctctgacgctaaggaatgggcgttatgcatgaaagagaaaggcttttcctacaataccattaacaactataaacgctcgttaaaagcgtcattctacatagccattcaagatgattatgtgaggaaaaacccttttgatttcaagttgagtgaagtcctagaaaatgataccaaagagaaagtcgcattgacagaggaacaggaacaagcactactgtcattcatcaagacggacaacgtgtatcataagtattatgatgatgtgctgatactgttaaagacaggacttcgtatctcggaactgtgcggactgacaatcatggacgttgattttatccatgaggttgtggttatcgaccaccagttactaaagagcaaggaacagggctattatattgaaacgcctaagacaaagagcggaacaaggcaagtaccattaagcaaagaaacgatacaggcatttcaaagggttatgaagaaacgcccaaagtcagaaccatttgtgatagatggacggggcaacttcttatttgtcaatcacaaaggcaagccgaaagttgcgattgattacagtactttatttgtccgtatggtaaagaaatacaacaagcaccatgagaacaaccccttgccacatatcacaccgcatacgctacgccatacgttctgcacaaggctggcaagcaagaacatgaacccgaaagatttacagtatatcatgggacattcaaacatcagtatcacaatgaactggtacgctcatgcgtccatagataccgcaaaatcagaggttcagcgtctaatcgcataagaagtatttaccacgattttaaccacgtttgatagcgaaaatataagaagatagacctagatatgtgaggtttaccacaaaatcaaaatgcccgtagagcctataaaataaggctttgcggacatttaagaagatataaaaagatagtcaaaaagacatatataatttattataatgaatataagttttataattattgatgttgatatttctgggtccatgtctaaaatatactcaactgtatagataattttgccatagattcactacactatctaaaacatctaataattatattgataaaaattgttttgaataatgattgtcttttttttataaatagtgctataatatttacatggtctgttggtgaagcggtcaacacactaggttctcatcctagcattcacgggttcgaaccccgtacaggctaccaaataaaaataacacccacgtaaggggtgtttttttgtttggttttgaattgacgagtttattgaggaaattcatcttcatcaataaactcataacccgagtgacggtcatcaacagctttagcaatttgaattttataatcaagatttttttgataatcaaatgaaaaaattcctgcataaagagtatccagtaagtatttaatcgatgttgttgttgcaaaatctccaatctttgtatgtaacatttcacgtgatgaaattcgtaatgttacatcagcaattttagaaaggcgattatttgcaatacaggtaatcgcgatgattggagtttctttctttttcaataccttagcaacctcaataataaattctgtttctccagaatatgaaattaaaatagcacaatgggtttcatcactcattgccgcttgaaccttgggattgccaggcagacgacagatatttacattacgatgaatataaaataatttacttctaaatccttctgctaataaaaggttattagaaactccatagagatctaattctttagcatttcgaagataacgtaaggccgtttgtaagtcatcatgattcagcatggacatcgtgtcttgaatcgcatcaatttgaagttgaccgatattattagaaattgtcataatatcatcactaacaacaaaaggaatactagcatcgaccttttgttctttaaataaatattcgagttctgcaataaaatcttctttaaaggcgttccagccggaataacctaattttttggcaatacgtactaaaagtggggcagaagtgaatgttgctttagcaatactgttggctgacatattctttatttttaaaccttgttcaagaatgtagtcaataataatagcttcacttgatgaaaagtgagtatgttcaagtttgtgaattattaacatattttttacctcgctttatttcattatacgtgtcgaagacaaaagagtaaaccaaaaagaattaaaatgataacgttttcatttcaaatgtggtagaatataagtatgcagctaatgatgaggaaatttctgagtcaaagggtgaacaattatttttgttttgttcaaccattagtacgccctaatggtttttagtttaaggaggtaaaatggaaagtagaattgcaattttaggaatttttgtttatgaattagacagtgctaataagattaatgacttgttgcataaatatagtcgctatattattgggcgaatgggaattccctataaagataagcaagtatcagttatgtctgttatcgttgatggaccaaatgatgtaataggggctttatcgggaaaaatcggaatgctcaaaggtgtcagtgtaaaggcactatattcaaaaggatagaatgagtaatattgatttaattaacaagcttcatcaagaaggcgcattggattttgatgagtttaaaagattattaaaaacatttgatcaaaacgattttgattacgctaagaagattgctgcgaaaatcactgaacaaatatttaaaaataagatctatattcggggattaattgaaatcagcagttattgtaaaaatgattgttattattgtggattacgtcgcagtaataaattagcattacgctatcggctaaatttagaagaaatattattatgctgcaaagaaggttatcgcttaggctttcgaacatttgttttacaaggtggagaagacgaatattaccaagatgaacgaatggtagaaattattgagaaaataaaagaattatatcctgattgtgcaattacgctatcgttaggagaaaaaagtaaagaaacttatcaaaagtattttaatgcaggtgctgatcgttatttgcttcgtcatgaaacttataatagagagcattactatcagcttcatcctcatgagatgtcatttgataatcgaattgactgtcttttgaatttaaaagcaattgggtttcaaacaggatgtggatttatggtaggaagttatcatcaggatattgattgtctggttaatgatttattgtttattaaagagctaaagccggaaatggtagggattggaccatatttagtgcatcaaaatacgccttttaaaaaccaaccaaatggtgatttaaaacttactctttttttattaagtttgattagaattatgacaaaggatgttctattgcctgcaacaactgctttagcaactttagattctaatgggcgcttagagggaattaaccatggttgtaatgttgtgatgcctaatttatcacctcaggaggtaagaaaaaaatactcgttatatgatggaaaagcagcgagtggacaagaagcgagtgaaggattaaaagaattaattgatacgctaaagacggcgggatatgaagttgtatatgagcgtggagattattgtaaatttgattacgagggttagacctaagtaaaagaaagtgagaaaaaggaaaatgtataatgtaaaatctaataaggctgaagaatttattgatgatcaagaaatactggaaacaattgcatatgctaaagaaaataaagataatcgagaattaatcttttctttaattgagcgtgctaaagactgtaaaggattaacgcaccgtgaagcaatgctgttattggagtgtgaaattcctgaagcaattgatgaaatggaaaaagttgctaaaatgattaagcaaaaattatatggtaatagaattgtaatgtttgcacctttatacttatcaaattattgcgttaatggttgtgtctattgtccttatcatttaaaaaataagcatattgcaagaaaaaaattaactcaagaagaaataaaaaaagaagtcatcgcacttcaaaatatggggcataagcgtttagcattagaaacaggagaggatccaatcaataatccaattgaatatgtattggaaagcattaaaactatatatgggatcaaacatataaatggagcaattaggcgggttaatgttaatattgctgcaacaacagttgaaaactataaaaagctaaaagaggctgggataggaacttatattcttttccaagaaacatataataagaaaaattatgaagcactgcatccaacgggaccaaaacatgattatgcttatcatactgaagcaatggatcgggctatggatggtggaattgatgatgtcggtattggggttttatttgggctagaaatgtatcgatatgattttgtgggtttattgatgcatgccgaacatttagaggccgcaaaaggagttggaccacatacgattagtgttccgagaatttgtccagcagatgatattgataaatcagactttagtaatgctatcagcgataaaatttttgaaaagattgtaatgatcatcagaatggcagtaccatatacgggaatgattatttcaacacgtgaatctaaacgggttcgagaaagagtgttagagttaggtatttcacaaattagtggtggctctaagacaagtgttggcggttatgatgaacctgaaactgaagaagatactacttctgcacaatttgatattagtgataatagaactttagatgaggttgttaagtggttatgtgaattaaattatattccaagtttttgtactgcttgttatcgcgaaggaagaacgggagatcgttttatgcaattatgtaaatctggtcaaatctcgaattgttgtcatcctaatgctttgatgacattaaaggaatatagtcaagattatgccggtgatgatactaagttaaaagctgataatttaattatgaaggaattagataatatcactagtgataaagttagaaaaatttgtcaagaacgtcttacgatgattgaagacgggaaacgtgatttcaggttctaataatggcagggttaaataaaacaccaggagctaatcggctccatattggtttttttggaaaacgtaatagtggcaaatcggcattgatcaacgcctttgttaatcaagaagtttcaattgtctcaagtgaaccgggaacaactactgatcctgtctataaggcgatggaaattgatggtttgggaccatgcttgttagttgatactgcaggttttgatgatattgggactctagggcaattgcgaaacgataagacaaaaaaagctagtgaaaagattgatattgcaatcattctttttaatgatagaaagatttgtcaagaattagactggtatcattattttaaagagaagcatattcctacgatattagtaataagtaaagctgatttacaaaggaatgataatcttctaaagaaaattactgaagcaactagtgaaacaccattactgattagttcgttaacgaagcaaggaataaaagagttacaggaaaaattgcttgaaaaggtaccggctgattttgaaaaagaaagcattacaggtgaattagcaaaaaaaggtgatcttatactattagtaatgccacaagatattcaagctcccaaaggcagattaattttaccccaagttcaggtaatgcgtgaattgcttgataaaggttgtcaaattatggctgtaacaacggaacaactaaaatcagctttacaaaaattaaatcaagcccctgatcttgttattacagattcacaagtatttaaatatgtttatgaaaatatttcttcagaaagcaaattgacatcattttctgttttaatggcaggttataagggagatttaaattattatgctaaaagtgttgaaatcttagaacggctgaatggtgattcgacagttttaattgcagaatgttgtagtcatgcaccattaagtgaagatattggacgggttaaaattcctcgaatgttaaagaaaaaatttcctggaattggtgttgaaattgttagtggaacagattttccagatgatttaaccaagtacgatttaattattacttgtggtggctgtatgtttaatcgccggtatattatgacaagagttaatcaggcaaaagggcaaatgattccgatgacaaattatggcatttttattgcatatgtaaatgggatcttggataaagttatatattaaaaggactattcaaatgatatagaagtaaaataaaggtagatattggaactaatatctaccttttcattacatttgcatcatggagtatctttttaattactcaaatgtttcagcgacttcttttaaatatttaataattggcagatgctgcggacaaatatgttcgcattgttgacatccaatacaagtagatgccttgccattagtttttgtgtgaactccataataataatcactattccagtcattaaatatttttttatcattataacagccaaataagtcaggaattgaaattttcatcgggcagccgtctgtacaataacgacaagcggtacaaggaattcctcctaaggaatctaatatttttcgaacttttgctaccgcctcgtattcctcatcgttaaaaggaatgaaatttttcataaccttcaaattatctttcatttgctctaaattactaacacctgataaaactttatatacaccttcaaaagacgctgcaaagcgtagagcataactagcgttgctggcatttttatttagatcagttaaaattctatttgctgcttcgggaagattcgcaagaccaccgcctttaattggttccattactaaaataggtttattaaatttgcgacatacttcataaaccttcttactttcaacactaggattattaaaatcagcataattaaattgaatttggacaatttctatttcgggatgttcacttaagatcatctctaaaatatttgcagtatcatgaaatgaaattccaatgtgtttgacttttcctgttgcttttaattcttgagcagcttgataagcttgacatttttgaaaatgcttataattttcacggtcttgtgcatgcattaaataataatcaaaatatgaaacacctgttttttgtaattgctcattaaatagtggaagaatatcttctttgctgttaaaaaaacttttagttagtttgttagtaaggacatatgattcacggggatagcgtgagactaaacaatcacgaagtgcggtctcactttttccgcctagatacccgtgggcagtatcaaaataattaaatccttcctgcatatacaaatcaatcatttgattaaactcgtcataatcgacttcatcatttttcattggtagtcgcatacaaccaaaaccaaatttattttccataattaaccttctttctattatagttgtattaataaatttatcatacatcttagagttaactagaagtcaatatttgaataaataaaaatagttttaacaaagaataatttttgattctatttaaaatagctaatatttttagaatcaaagcgatcaatcagtggctttgtttcattactgtaaccaacagctacaacaccaacgggatattcattatcagctagattgtaatagtttttaaaaccttcaactctttccgaaactggagcgattccacaccagcagcaaccaagcccttgattgactgcttcaattaaaaggttttcaattgctgcactacaattgattagaccatattcaggtgaaatagctttatttaaatcagctattacgagaatagcacaaggagcttctttcatcattgttgtatatggtgataatttcgtcatatcatttagtgcttgagaatttgtaataactttaaatttccattcttgtgtattacgggctgtcggcgcgttcattgctgcttttaaaagttctaagattttttcaggttcaactggtttgttcaaatactttctaatgctttgacgttgttcaatttcttttaacatttttattacctcgtttctagtatgattataacgcagaatttataaatacttaagataatattactgtaaattatttatatatttatgctatagtaggactagaggtgaagtgaatgttggaggcacagcatataaaaataaaagtagtaggagaatatcgctgtattgtaatcagtgatattcactctcacttagatcgatttaaagcactgctaaaaaaggttgattatcgatacgatgattacttgattattttaggtgactttattgaaaaaggtacgcaagctttagaaactgttagatttttacaagaacttcaggcaaaaagtgagcgcgtatatgtgattcttggtaattgtgaatatgcgttagaagaaatggtagataatcctaaatatgctaaccaaatagttcactatttaaatcgtattggtaaaggcggaatgattcgacaagctctagaaaaattgaatatagacataaaaaaagaaaatcctgaagtaatgcaggtaaaaataaaacagtttttgcggccatattttcaatattttaaaactttaccaacaatactagaattcaataattttatttttgttcatgcaggaattgaaaatcgaaaagactggcaaaattcatctacttcatcgcttattgaaatgcgaacgttttatcaaactggtcactgtttagataaatatgttgtggttggacatttaccgacatcaaatcaatatgctaatgcaatcaataatgatattatcattgataagcaaaagcgtattattagtattgatgggggaactggggtaaaatctattagtcaattaaatgcattgataattactggtgatggcgatagatttaagttatcaaaagaatatatacagccgttaccgttatatcaggcagtagttgatgttaatgtagaaaaacaagttgtcaataaagtggcatggcctaattttgaagtcgaggtgcttaagcagggaaaattattttcaacctgcaaacaaattaaaacaggtaagatttttaagatcaagaatgaatttttgtatttaaataatcaaaaatattattgtttggatgactatgttgattatttgattcctttggaaaaaggtgaggtaattaaattagtgggaatatacggtccttatgcttatgtgatcaaagataacgaaataggatgggttaaatatcgttatttaaaaaaagtaaattagatatctgaggataattgggtatctttttttatacagcgggaataattttcattattataataaaaaaatgtaaatgtgtaggctaaatataagatttttgttataatagaaacgttgcgaagcaaatgaactgtttttatttataaacaattagttttgcaacccgacgggactaaaacgaacacggtgttgttcaagattaggagggttttatgtcaaattcgaagaaaatcgtttggtataacttagcctttatggccttttcgactgtttggggattcggaaatgtggttaatggttttgtatactttaacggagtccaagtaatttttagttggatcatgatgtttgcactatacttcgtaccatatgcattaatggtaggagagttaggctcagcatttaaaaatgctggtggtggtgtgagttcatggattcaagaaactttaggaccaaaattagcttactatgctggatggacttattgggttgttcatatgccttatattgcttctaaagcatcaggtgggctaaaagctttaagttgggtattgttccaaaattcatctttttatgattctttggatattcgcctagtccaaattattaccctggtagtatttttagtatttgcctgggtagcatcacgggggttaaatccattaaaatcattggcgactattgctggatcgtcgatgtttgtaatgtcaattttatttattatcttaatgatggcagcaccggctttaaatcctaatggaggatatcaaactattgattggagttttaaaaatttaattccatcgtttaggttagaatattttacttcattatcgatattagtatttgccgtaggtggatgtgaaaaaatttcaccatatgtaaataaagtagaaaatccttcaaaaggatttcctaaggggatgattgcattggcaatcatggtaattatttgtgccattttgggtacaatttcaatgggaatgatgtttaatgttgctgaaattaatgctaattttgattcatatgtagctaatggagcatattggtcattccaaaaattaggagagtattatggtattggtaataccttcttaattgtttatgcagtatgtaatatggtcgggcaattatcaactttggtaatttctatcgatgcgccacttagaatgttattagacaatgaaaatgcgcgtcaatttattcctgcaaaattattaaagaaaaatgacaaaggcgcatataccaatggaattttgttggtagtagcaattgttacaccattaattttaattccggcgttaggaataggaagtgttacggcatttttaaaattcttgacccaactaaattcagtttgtatgccactgcgttatttatgggtgtttattgcatatattgcattgcgtaaagcaattgataaatttccagcagaatatcgctttactaaaagtcaattttttgcgaaattttttggatggtggtgttttattgtcactgcagcttgttgtgctttaggaatgtttaaaggaagtgcatttgaaatcgcaatgaatattattaccccaattattttagttggattaggagcaattatgcctgctctagctaaacgtggtaagacaagtcaatagtatcttagacatatcctttaacacatgttaaaggatatgttacaataaagccgtaattatggaggtcatgaaaatggataaacaaatatcacaggaattagtaacttttattaagcaaagcccaactgcttttcatgctgtagctaatatgcagaacattttaattgaacatgggtatgaagaattattagaaggacaaacgtggcaaattaagaagggtggtcattactttgtcactagaaataattccagcattattgcttttaatcttggtgagaatttagataattatagttttaatgttgctgcatcacatagtgattcaccaacttttaaagtcaaagagaatgctgaaattgaaataaaaggtaagtatacgcaattaaatacagagggttatggtgggatgttatgtgctacctggtttgatcgcccattatctattgcaggtagggttttagttcaagaaggtgataactatgttaccaaactagtaaatattgatcgagatctagtaatgattccgaatgttgcaattcacatgaatcgtactgtcaatgatggttatgcttataataaacaagttgatatgttaccgttatttggtggatctgaaactaaaccaggagatttaaagaaactgattgctgatgaattaggtgttgatgttgaaactatttatggaacagatctatatttatataatcgcatggaaccatcaatttggggagctaatgaagaatttatttcatgtccacaactagatgatttacaatgtgcatatacttcattacaaggttttctcaagggagcaaataagcaatcaatcaatgtatttgcctgctttgataacgaagaagtaggttcaggtactaaacagggtgcaggatcaacatttttatatgatgctatgcgtagaatcaacaatgctttaggaaaaggtgaagaagaatattatcgggcattggcttcaagctttatgttaagtgctgataatgctcatgctgtacacccaaatcatcctgcgaaaacagatgttaataattgtgtttatatgaatgagggtattgttgtaaaatctcatactggtcaaaaatatactagtgatgcagttagtatagctgtttttaagggattatgtaaaaaggctggagttccagtacaatttttctctaatcgcagtgatactgctggtggtagcacgttaggtaatattgcaatggcacaagtttcaatgaacagtgttgatataggattacctcaattagcaatgcattcatcttatgaaacagctggtgtcaaagatactgcttatatgattaaagtgatggaagaattctttaatagtcatattgaagaaatgagtggacatattttaaaggttactaaataatgaaaaaagaaaaaactagtaaaaagcgattaaaagagataaaaaaagaagtacttgaaaagtatattattgctggtttatggcaaacgatgtgtggctatattgttttactttttatcaaagaattattaactgataattatttagtcagtttttctgttgatgttttgattgcgattattgctttctatgttacattacataatctagttaatcaatacaaactaattaaggaaaatcggttgtcattaaagcctttctcttttcaaatttttggaattattgttggtttgttcattgtaatacttactttaaagagtccttttgatatttcttttgcgattcttgtaattgcttttttaacaagtaaaaaaatgtttgaaaaagaactaatgaaataactgtacgtttgtatggctattttgataactactttttataatgttatcagattaataaaaaagtcacgatattgatttgtcgtgactttttttagaataattaatttaatgagataatttttcttcttttaatttattagcaacatccatttgatgttctttttcttcttgaagtttgactgccatttcatcagtagttagtttatgtgtttttggttcttctttagctttaccaaaaactttttcaaaagcttcttctgcttctaaatcaattttttgttttaaatcatttaattcatgtaatttagcttcatgatgagcaatttcttcattaacgatagctttaatttgatctttagtaagtggtgtaacattttctttaataagatctttaccttcgttaaaataagtttttaaagattcaatagcttgttcattgatttttttagtattcataataatttccctctttcttttgttttcatttgtaatatatgcttctgtgcaaaataattctatatataataatcatttataaatgctgttaacaaaatttctactttcaatttagattatttgttaatggcattaacaaatgttatttccttaatttagctgtttttaatttatttgcagtttcaatttgatgagttttttcttcttgtagtttaactgccatctcatcaacagttaatttatttggagattttttgctggtaatccttttacctaaaaccttttctaacgattcttctgcctcaatagcaatattttttctcagcacttcaagtgattcaacttttttttcttgagcttggatttcttcgttgacaattttagttatatcttctttatccaaaggctttcgctcaaaatcattcaatactttatcgggattatctttaaagtaagtgtttaatgaattgagtgcttgtttttcaatttctctcttattcattttaattaccttctttccttaactacactcgtatcataatcgttactgataattttggaaagtaaaaaatagttgatttaaatactattaacaaaattagaagtttttttatcatagttctgttaatgttgttaacaaaatatcgggaataaagttattattcgaaagattaattttatatctaataatattttttgaataagtcgaaaaaagcttaaattactgtataaattagttatattgttgctttatcggcatatagtcttaaagaggtgatatcagaagatgagctcaaggattgcttacaacagtaaggaagtagaattactagcacggttgatcaaggctgaagcattaggcgaaggtcaagaaggaatgctgttagttgggaatgttgtcgttaatagagttgctgcagtttgtgatgtatttaaaaatgttgttactattacggaagcaatttatcagaaaaatgcttttgctggagttggaacagatttatttaatggacctgttaataccaaagaaaaagaactagcgcttaaaacaattaaaggttatcggaatgctccagcaacatatgcgttatggttcaaaaaccctggggataatgttacttgcccaaaaacattttatggagaattttcgggtcgatttaagaatcattgtttttataatcccggaccaaatttagtatgtgaaatctaaaggagatgcatttatgaattattttgaagatttaaatccttattttgttagacaggatccagatgctgaagtgaatcctgacggtacactgataccgcctaaaaaccctaatccggcagctgtaccacaaatatatatgggaaatatcattcgtttgaatatcggtaagcttgggactttttatttcacttatagtgatagtgagaaatggcgagatgaagtttttgttggtatagttgaggatgcaggtcgagactattttattattaaagatgtaaatagtgaagatcggtttttattaccgttagtatattttttatgggctcgatttaagggcgcaatctcgtttacggtaccgccacaataactaataataaaggatagccactttaatgataaatttttgaggttatcctttgttgttataataaagcttctaaaaaaatgtacaagtagatatacaatccttattcttaatactataataaggttggagggataattatatggcaaccggagacgtaatcgattttttggaaagggaaggatatgacttagattttattaagacagcaaatcgttatctttcttatgattctgaacatcttattttgcaatgtaaaaatgatatattagaatttggtgaaaaagaacttgtaaaaatgtatttagataatgacattttttatagttatactttgagtaggttcaattcaaaggttgggttagcctattttgaatgtaccctgaaagatgctttttcaatttttacgttgcaaaatatttaaaattatgtgttaaagctctactaagatagagtttttttgtatatagaatatttttcagttacttaccctcttgacattaaagttaactttaggtttatactaggcaatgtaagggggaaaattaatatggatgaattttatcaagatttattagaaccggttgtttatcgctgggttaagacgcatgaacatatcaaagtctgtgaaaatcaatgcactctatgtattgatggaagtaacagtaccggaataatcagttttcataatgagggaatcgttgaattgagtgtaaagaataaagatagtgatgaaatattgttttatttacattttcaaatgcatgattttaaatctacaatggatcaatttaatacattttttaattatctttgtttacccacaattaagcttggtgagagcattttcaataatgtaaatactaataaaattttacttagttgtagtggcggtctgacaacttcatattttgcttattcaatgcaggaaatttttaaacgtcaaggcttggatatagttgttgatgcggtaggatatatggaaattgataaagttattgatgattatgatatggttttattagcaccacaagttgcttatttactgccacagttgaaaaataaatatggaaataagatttttattattgattcgctagattttgcaacgaatgattttaatgccattataaaaaaagcagttaattaatgaagcattagataagttcaattactttttttaaaaagaaatctgcagctttggaaaaaatttgatattttttccaaacaagatctagtccaacttcaagctttggctctaatggtttaaaacataatgtactattgtatgtattaattaatttatcaagtgttaaggcatatccagaaccttcatcaactaataatgaagcattgtagattagattataagtagcgacaatatttaatttgtcaaaatcatcttttagccaccctgaaagttcatttcgaacaaggtcttggttagaacaaatcagtggcaggtcttttaaatcctgggggttgatatattctttggatgctagaaaagcgtcttttttcatcaatacaccccagcaatcggtataagggagcttaataaaatcatattttgaaaaattagtcggctcaattaaaattccaaaatctaatagacctttatcaagtttttcagtcacatcttgggcatttccactatagagatgaaatttgatttctggatgaattttttgcgtttctttaatcgctttcgttattaatcgcattccttctgtttcaccaccaccaatataaatatcaccactaatagtttcattatcagaagtcatttctgcttcagttttattaactaagtcaataatttcttcggctctttttctaaagagaattccatcatctgtcaaggtaatccgacgattacctctaattagtaactgcttaccaagttcattttcaagatcttttaattgtcttgacagggttggttgggtcatatgtaaataatcagctgcagcagaaatactttcttcacgagctacagtaataaaatattttagaactctaagttccatacaaatcaactcctttaaaatattttaacatgcatcaatatgcctttcaagcataggaaactatttaatataagtatttgctatccgaaaagctatattttagaatatagctgaaggagatgataaagtgatgtgttcaaatgatacacctgaagcggtatatcaaaacttattagatgcaggttgtgatagtaaattagtagatagatttatgctattatttgcacataaaaactatcaaggacaattacaaattttgtcagaacaaagaaaggaattattagatgaacttcatctagttcaaaaagaattagactgtttggattatttaatttataaaataaaaaagctttatttaaatgactaattgattatttatatgacaaaggggagattttgatgggttacactattcgagaagtatctgaaattttaaaaataccagtttcgacgattcgctattatgaaaatttggggttattaccagtaattcaaagaattgaaggaaaacgtgtgtttacaaatgaaaatattactgatttaaagcgaataaaaaaactaaaagatatggggatgacattaaaagatattaagaatttcaatcaattatattcaaagggaaaactgtcatttgaacaaaaaattatgatacttgatcaacaacatactgtaattattgaacaaattgaagaacttcagcatacgctagagatcattgaaacggaacgtttaaaatatagcaatattatcaataaaaatcatactgcaattatttgcagttaataaataagatgaaaaagaaatatattttttacttctagtattaatattgataggctatctggttaaacaaaatatagataaacaaggaaaagaagaatcaaaagaaatgataaaaataaagattgagattaatggacaaatgtttttagctacattagatgatactccaacatcccaggctttattggaaaaattgccgatggtacttacaatgaaagagttaaatggtaatgaaaaattctataatttagaatactctttgccagtaactagtcaatcagttaatcaaattaataaaggagacttgatgctatttcatgacaattgcttagtattattctatcaagacttcttatctaagtatcagtatacgcgaattggtcaaatagatgatgcaggtaatataaatcaaattgtgggtgcaggagatctggtagttagctttatgaaatatagaaatggagaagaaaatggaaataattaaacaaaaatatttaagcggtgaaagagcactttttaaaagtaataatctaaaaattgaagattctatttttgctgatggtgaatcaccgttaaaggaaagtaagaatatagaaatcaatgagactatttttaaatggaaatatccattatggtattgtaatgatgttaaagtcactaattcaacattgttggaaacggcacgctcaggaatttggtacactaaaaatattaatattatagatagtattattgaggcaccaaaaacatttcgtcgagcacaaaatatttatttagaaaatgtagatttgccaatagcgcaagaaacgctttggaattgcacggatattgttttaaaggcagcgagggtacatggtgactattttgggtttaatagtataaatattaagattgatgatttgaatttaacaggaaattatagttttgatggtggaagaaatattgaagtgcataattcaaagctgatttcaaaagatgccttttggaattgtgaaaatgttacagtttatgattcaacgatcattggtgaatatttaggatggaattctaaaaatataacgtttataaattgtacgattgagagtttacaaggactttgttatattgaaaatttaaaactgattaactgcaaacttattaatacaacacttgcatttgaatattctacagttgaagttgaggtaaattcgcatattgatagtgttgtgaatccaatctcaggtgtaattaaagcacatagtatcggtgaattaattctagacaagaccaaaataaatcctagtgaaacaaaaattgtgataacaaatcctccaataaaaagccaaacaaatatcgaatgtatatgttgttagaggaggagaaaatgaaaaatcaattttcaaaactgacgaaccgctggaatagtggttctttgaagtgggaaattaaagagaatgaacttcctatgtgggtagcggatatggattttgaaactgcgccagaaataatcgaggctctaaaacaaagagttgagcatggtatttttggatataacatcgttcctgatgaattctttgaaagtattcagacctggtggctaaaaaggcataattattatctagaaaaagagtggatgttattttgtacaggggtagtcccagcaatttcttcactcgttagaaagatgacaagtgtaggagaaaatattttaattcaagcaccagtatataatattttttataattctattttaaataatggacggcatattatttcgagtgatttaatttttgatggaaaagaatattatattgattttgtagatttagaaatgaagctggcagatcctcaaacaactatgatgattctttgtaatccacataatccaattggaaaaatatgggacattgaatcattagagcggatcggtgaaatgtgcgctaaatataatgttttagtaattagtgacgagattcattgtgatcttactgcacctaataagaattatattccgtttgctagtgtttcaaaagttaatcagatgaatagtattacttgtattgctccaactaaagcttttaatttagctggactacaaactgcttgtattgttgtcgctaatccacaattacgacataaggtaaatcggggcattaatactgatgaagtggcagaacctaatagttttgctattacggcaacagttgctgcgtttactaaaggggcagtgtggcttgatgaattgagggaatatattgaagaaaataaaaatatagtatctaaatttattcgatgctatttaccagaaatttatttaattcctagtgaggctacttatttattgtggcttgattgttcacgaataacaactgacagtacaatgttaacacaatttattcgcgataagacgggtttgtatttgactagcggaattgagtatggtgaaaatggtaatggatttattcgaatgaatatagcttgtccacaatcacgattattcgacggtttagagagatttaaagagggtataagagcctatcagcaaggagaaataaaaatggaagagattgacatagaaaaaatgcatcaatttgaagatgttattaatatggaaatattttataataaaactactcaagaaattatggaacaatactatttgcaaagagaaaatgcagattctctagcaatgcaagattttacgttgactgacgaagaattaagggtgttggatcaattaataaaaatttatgacaaactttttataaaaagtccgattatccgcataaatactgtgttttttaaagaaatagcaattaaaaatcattcattttaccacgaatttactacgtttgaaagagccttgatttgacgataataaagaagttgaaagggaagataacagctaataatcttcccttttctcatgtttaaacggatattattttatctttaattcaaatttcagtattgcctgaatcaattctgtttggattctaccttttaattcagtatcaactatcatatcaactttacttgacttattatatagaggtcgtagacatacctttgatatgtatgcgtcataacatttcaacaagtttataattgcgatttcatcaccattaaccgccttttcaatcatttcataagatggtaattcagttgtttttctcattcttgttttcctttcatttgtgttttcaatttattcagagcattttttctactacgatatatagcagaacgtgagcattgaaataatccagcaatttcaatatccgaaaaaccgagaaaataaaacagtaatatcacatgaagttgtcgagtgggtaatttcttcaatgctttacctaaattttcattagatatttggacagcaaaatcacatatataaaaagttatatattcacttggatataggtcacagatttcattttcatatgatatatctaataaatcacaaaatgacttttcgtgtttagaacgtctagcaagttccctgtaataagagatagtctttcttctgataaccaatttcatcagagtgtcaaattgtaatcgtataatttcctcaaaagaagatgtattcaaggtatcacctcctttcgccgagaattacaaaaggaggaaatacaaaaaagcacaagaacataaataataagtgttcttgtgctgtattgactattcctgctatgtcatgtgaaaaaccatataaaaaagcaaaaacattctttatggttaaatttacttttttgacagattgaataatgtattttgtttattatgattttcttccatgaatacctcctgtagtgtctgctttcttcaaaacatagaagaaaagcaacaagactaatcatagtaaacaaatccgtccaaattccttttaagaaactgttttttagcagtaataataagtacacacttttttgagaaattactattatctattgacaaaacaaaaaaactaaatataatagtaactaacagtgatagataaaatcggaggtgattcttttgaacaataaagaaatggcaaaacagttatttatgcttgttggtttaatgcaacgtgagcctattaaaaaaatgcagaaaatatcacaaggcgaaatggcaatgcttggttttttaacgtatgaaaaaagtgagacaaatccaaaagaattaagcgagcgtttcaacttatctactgcaagagtggcaaatacgttgaacagtttagaacgtaaggaatatataaaacgtgttcatgattcttttgaccgtagaaaagttatggtttatataacagaaaaaggaaaagaagtttttactgaaacagaaaaagaagcattaaatgaatttagtaaattattatcttatcttggtgaaaatgattctttatgtttgctaaaaatcatagataaaatacaagcattttacagtcaaaaataatgtgttaactatgccaacatactatttgttggcaaatatttaacacatttatctatcactaatagtaagtatcactaaaagttaaaggaggaattgtcgtgttaaagactttattgaaacaaataaaacagtatagaaaagcgtctgttttagccgctgtctttacggtgttagaggttatcttagaactcattattccaatgcttatggcagcagttattgataatggcattgaatctggaaatataaacaatgtttatttttatggtttatgtatgattatgacagcagttttaggtcttgcttgtggagtattggcaggtagatacgctgctatcgcttctgctggtgttgcaagtaatataagagatggaatgtatgaaaatatacaaacatttgcattttcaaatattgataaatacagcactgctggattgataacaagactaacaactgatgttactaatcttcaaaatgcttatcaaatgattattagaatgtgtgtaagagcccctatcagtttaatcagcgctcttatcatggcgttatatattagtgcaaaaatgggtggaattttctgcattgctattgtattcttgactgctgttattattttcatactatggaaaacaattcctatatttagtcgtgtttttaaaaaatatgatgatttgaatgcaagtgttcaagaaaatgtcacagcaattcgagttgttaaatcttatgttagagaagattatgaaaaagaaaaatttaataaagctgcctctcttatatataagctttacgttaaagctgaatcacgattagcattaaacaatccggctatgatgacagccatgtatggttgtattatcgctatctcatgggtaggtgctaaaatgattgtcagtggaagtttaacaacaggtgagctaacaagccttttcagttatgttactaacatacttatttcactaatgctaatatccatgatatttgtaatggtgagtatgagttttgcaagtgctaaacgtattgcggaagtccttgatgaaaaaccagatttaaaaaatccagattctcctgctatggtagtagaaaatggcaatgttcaatttaatcatgtgagcttttcatataagaaagatggaaatggcgaaaaagttctttctgacattaacattgatataaagcaaggcgaagtgatcggaattgtaggaagtacaggaagttctaaatcaagtttagttaatcttatttgtcgattatatgatgttacagatggctatgtaaaagtcggcgataaagatgtaagagaatacgatttagatattcttagaaatgaagttgcagtggtattacaaaagaaccagcttttttcgggaacaattttagaaaatttaagatggggaaatgaaaatgcttctttggaagaatgtatgcaagcttgcaaactagcacaggctgatgaatttatccaacgatttcctaaaaagtatgatacttatgttgaacaaagtggagcaaatttatccggcggacaaaaacaacgattgtgtattgcaagagcccttttgaaaaagccaaaaattcttatattggatgattctacaagtgctgtagacactgcaacagacgcaaaaatcagagaagcatttgcaaaagatataccagaaacaacaaaatttattattgcacaacgagtgtcaagtatacagaatgccgataaaattatcgttatggaagatggcaaaatcaatggttttggaaaccatgatgaacttttaaaatgtaatgagatatatcgttctatgtacgaaagtcaaacaaaaggaggcggcgattttgatgaataataaacaaaatggagtatctcgtcttttaagattagtatggaaagaatataaaatagaaatgttggttgttattttagcaatcattggttcagctcttgcgtcagttaaaggtacgttgtttttgcagacgttaattgatgattatattgtacctctaacggaaagcaattatccaaattttgcaccattagcttcagcattgtttaaaatagccataatctatatcttaggtattctttgttcttatatctataatcgaatcatggtgaatgttagtcagggaactatgaaaataataagaattaaattatttaaccatatgcaatcactgccaatacagtattttgatagtcattcacatggagatattatgtcgatttacacaaatgatactgatacacttcgccagtttttaagtcaaagcattcctcaattatttaacagtatcataacaatcgtaagtatttttgttgcaatgataatattaaatattccgcttacaattattactctagtcatggttgctattatgttagtcgttgccaaaaatgcagctacattaagtagcaagtattttaatcagcagcaaaataatttaggaaaacttaatggttttattgaagaaatgataagcggtcaaaaagttgttaaagtcttttgttacgaaaaaagaagtttagcacgttttagaagtgttaatgaagaattgaaagaaagttcacaaaaagcaaatatttatgggaatattcttatgcctattattatgcaaattggaaatgtaagctatgttatatgtgctgttataggctctatccttatattaaacggatatggtggtttaagcgttggaatgctagtatcgttcttaacgctcaataaaaactttaatcagccatttggacaagtaagccaacaattaaacagtattattatggcaactgctggtatcaatcgtatttatgcacttcttgatgaagaatcagaaaatgataatggatatataagtttagttaatatagaatgtgattctacaggaaatttaatagaaagtacaaaacgtacaggaaaatgggcatggaaacattatcataaaatagatgataccacaacttatcaagaacttaacggagaaattctctttgaaaatgttgattttggatatagtgatgaaaaattagtccttcatgatattaacctatttgcgaagaaaggacagaaaattgcatttgtaggaagtacaggtgcgggtaaaacaaccattacaaatcttatcaatcgtttttatgatattcaagatgggaaaattcgatatgataacattaatattagaaaaattaaaaaagcagatttaaggaaaagcttaggtgttgtattacaggatacccatttgtttactggtactattatagataatattagatatggacgattagacgcaactgacgaagaatgtatacaggctgcaaaactagctaatgctgacagctttattcgtatgttgccagatgggtatcaaacaattatatctggtgatggtggaagcttatcacaaggacaacgacaattactggcaatagctagagctgctgttgcaaatcctcctgtccttgttttagatgaagctacttcaagtattgatactcatacagaagaattagtgcaaaacggtatggataaattgatggcaggacgaacaacatttgttattgctcatcgtttatcaactattagaaatgctgattgcattatggtattggaaaacggaaaaattattgagcgtggaaatcatgaacagttaatcgaagaaaaaggtcgatattaccaactttatacaggtgattttgaattatcataaagaaatacaatttatattgaggtgattttaaatatgggaaaatattagttatttcactttcagatgatgaagaacaggttttttatcaaactgttaaatggctatcagatagacttaattgttctgatgttattataaaacagcaaccacaggcattttcccttaacccttatacaagaatttgtactaatgaatgtgggaaatctgtatacttaacagctaaacagtttgatttactatactttctttattcccataaaggacaggtattcacaaaagaacaactttatgaaaaagtatggggatatgaagatgtaatagacggaaaaaatctcacatcattcatacgaaagttaagaaaaaagatagagcctaccccagacaatccacagtatattattacagtctggggcgtaggttataaattcaatgaagaaaaaccgtagttacaattcacattcatgtgatctgtcaactacggttttttactgcttaatacatgcttttttacgtattatttcacaatctttcagttaatatatttttcccctatcaaatcaagctgtgaaatctgagttattcttgtctgtgtaaataacagtgtcaatatacttctcctttcttcctcttgattaccaaaaacagtaaagaaaaagtcctgtcaagaacatagccactgtaaagtggtgcggagcattcttgatcggactttttgtttgctgtatctttcacaaagaggagaaagactattcaatcccgtctgaatcttcaaatcccttgatggtcggcactttcgataaaatctccctgtcctcgtccacatgggtattgatgataacttctcccccgtcaaagtctgtatagggattcatgtgcttatgcccctctaaactttccccaaacatctcgacactgtataaatcatcatagcgtcttatcagtttttgaaatttgaaatattcaaccatttttttcaacgggtacaggtcagacgcttttctttcctctgcattgatgtattccatgatatattcacgcaatttttccagttcgtaggctttccattcttcctcgctgtcaaagaagttatcgtactgtccatgttctaactcaacattcagtctttcttcctctttcaaaaactgcatgatgtccttttccattggagaagtattcttccattctcccgataacagttcatttggggcaacctccagcacttccattatcttttccaatgtttcaaaggtcggataattcacgcccctttcaatcttggaaaggctctgcatattgattcccacagcgtccgcaagttcctgctgtttcatttttttcagctttctcactgtctgtatattttctcccaaatacttataattcatggcatatcttctcctttcaatcaacttataagcatatcatacttaatttaattcaaaaagtcaagaaaaatatcttgacaagtaactatgacagcgttattatatcatcagatagagcgattaagcacgttaaggtgaatcacaggcttgagtaagcatttagagaagatattttcactttgacagcatgaatacatatggactgtcggactgaaaatcgtggtttccaaaatcggctggctggacggggtacgtttcccaaacgtgctgcggacagacagacgggtttggaaaggaacgccttcaggcgttccgcttgcagggcgtatatgtaacaccgccctgcgtatacctgtcacagtaatagaaaactgcgataaatcaaggggaaaaggctgtttccccactgcacagaaatttgacaaacgaaaggagaaatgtagtatcgcaaaaagagaaaatttaaccgtcaagattgattacatcagcattatatttgacagtgcaaaggcagaggacgttataaggcacgttttggagcttccgcccgatatttttatcacttacccaaagaaagtcgcatttaagacgtatcaaacctgctggcagattggagatatttatctgtcgggcaatgcagaaaagacagaggacaacccacagggagcaggctgttatctcgttatgactggcagaggttgtgatgatattttccgaatccttgataatagaggtcatacttttggggaactgttcagacaatgcgaacgctggtttggtacagaatttcattttacaaggctggatattgccattgatgacagaaacgaggttccgttttttacgccacagcagttaaagaaaaaatgcgaaaaggaagaatatatatccagcagtgaatactgtaggaataatgagagcaaatatccccatgaggaatgggctggcactctttatatcggtgctggaaaatcggatatatcgttccgcatttatgataaggatagagaagtcagcacaaaatataaccgaacactggaagaaatcgggagctggaaacgaacggaaatccagttgagggataaaaaggctcatgcgtttgccatgcttttgaaagacaatccgctggatttaggacagcttgctttcaatctgctgtcttccaatctccgttttgttgttccgaacatgaacgagagcaaccgtagccgatggaaaacctgtcgattctgggagcgttttcttggaagtgtagagcctttgaaactgcatatcccacagatacataatacgctcatggaaacacagcaatggctcaaagaaggcggagtattgtcggcggtcaagggattttattacttggagcaaaatgacgcattaggggatttggagcgtgtggacgctatgctggaaacagtccgttatagtccttcctttgccggaaagctgaccgcacacttgcagaggataggcagagaggaactcataccctttatcctgtatgatacaaggcgttagggggtgtacgggttgaatagtaagatagacattcccgtatgggagaaatacaccatgacggtagaagaagcgtcaaaatatttcacgctcggtcagaataaaatccgctggctggcagaacagaaccgacacgccgactggtacattatgaacggaaaccgcctgttgattaagaaaaagcagtttgaaaaattcatagataaagcggacgttatttaatgcaaaagagccttgaatgtgatattattgggataagtcatatcaaggctctttccatttggaaaggagatatatatgtcagaaaaaagacgagataataaaggtcgtatcttaaagacgggagagagccagcgaaaagacggaagatacttatataaatatgtggacgcatttggaaagacaaaatgtgtgtattcttggaagctcgtgcctacggacagcgttccaaagggaaagcgtgattgtctgtcgctccgagaaatggagcatgagattcacagggatttagcggacggaatcgataccacaggcaagaaaatgaccttgtgccagctttacgcaaagcagaacaaacagagagccaacgtcaaggaaagcacgaaaacaggacgcaaacagcttatggagatactgaaaaaggataaactgggagcaaggagcattgacagcattaaaccctctgacgcaaaggaatgggcggtcagaatgaaagcgaacggatatgcctataagactatcaacaattataagcgttccttaaaagcgtcattctatatcgccatagcagatgattatgtgaggaagaatccttttgatttcaaactgaatgaggtcatagaggacgataccaaacagaaacaggcattgacggaagaacaggaagaaacgctgttagcttttgcgaaaacagacaggatataccgcaagtattatgatgaaatcgtgatactgttaaagacaggtcttcgcatttctgaactgtgcggattgaccgtcagtgatttggactttacagaaaaggttatccatgtagaacaccagttattgaagaacagcaggacaggctactacatagacacaccaaaaacgaaaagcggtatgcgtgatgttcccatgagcgaggaagtttgcagagcctttgagcgtgtcatggcaaggaaacagaaagccgagccgatagtggttgacggttacagccatttcctctttctcaatggaaaaggctaccctatgacgaatgttgcttataatatagcgtttgccaatctcgcaaagaaatataataaacagcatgaggacaatccgttaccaaagataacgccgcatatactacgccacacgttctgcacaaggttagccaataagagcatgaatccaaagagtttacagtatatcatggggcattccaacatcaatatcacaatgaatctgtatgctcatgcgtctgttgagggaatcaaggcagaacttagggaactgattgcctagattttaccacgatttttactacgattgaccgtgaagaaatgtgaaaaaacgtgaggaaacgtaagtatccgccgatagtaaaaatgcccgtatagcctgtaaaataaggatatacggacatttgaaaagatttaaaaagataatcagaaattcatataaagttttaaacaaaaattcctaatccaatctaaagcaatttaaaataagtccatcgtactataaaacagtctatcctattatagactgttttcattatataaattctacttctctttcatttaatcttatgacattcatacttacataagtaaatacattaataattccactgaatatatgccaaaaactagtgaattcttttgatttgtgttgtctagttatataaaatatttcagtatttttctaagattccttcccaaaatacaaatattcaattttatttaaatgaattttcatcaaatacacttgcttcagacagtacgaacatattcataaatggttgaaaaccatatattaacattaatccattttcttttaaacaacttgttacctttaaaaattgtacttctaaatcttcaaactaagtagttacttcaatcatttgattgattatgttatccataatatcaaatcataccttcattttacaatatttctagactgcaagggtcagtaacgtatttttaatacgatttaattctcgaatagctttatcaacttgaaatcgagcatctttgatctttgattgaaccatccaatcagcaatgattccatcaaagaaataatctgcaaaacttaaaaaatcactaatatttaaatcaacatcaaccagctgatctacatcacttaattctttttttagatttcgtatcgaattacgtgctgctgccattgctctttcagcttcattcattttaccatgtttgatcatcgttgtaataaaaccaccaccaatcatatcaaaaagtccccagtttcctgcactacttaaataatcctgagcccttgataaatgacctaaagtttcttcaattgcatgaagtgcttcattaacttcttttttctgattattttccataaactttcccctttgttatcaaatttcaagaatattttaccatataaaaaaataataatcagttaattatataatggcttgtaattttcttttctaattaatataacattccaataaaaaatatgctcccttctaagtacaagtttttatttcacttattttcctagaaaagagcaatttaatataatttttgtcataaattttatataataaaataaagtgaggtgtaagcatggaattaagagtacttaagtattttttagcggtagcacgtgaagaaaatatcacaaaagccgctgagtttttacatataactcaaccaaccttatcaagacaactgatgcagcttgaagaggagttaaacgcgcaattatttatccgaggaaaaaatcgaattgttttaacagatgaaggaatgctgcttcgaagaagagctgaggaaattgtagatctagctaataaaacggaaaaagaatttttagaacaagataatctagttacaggagaaatttttattggtggtggggaaacaaatgctatgcatattcttgctagaataatcaaagaatttaaagaagaatatcctcaaatcaaatatcaattttatagtgggaatgctgatgatattaaagagcgtttagataaaggattgattgatattggtttgttgactgaaccagttgatattgaaaagtatgagtttgtacgcttagagcaaaaggaagtttggggtattttagcacctaaagatagtaaacttgcagctaaggaatatgcaacaccacaagatttattaaaattgccattattaagtactcgaagaacaatcgttcaaaatgaaatagctaattggtttgggcaagattatgagcaattagatattattgcgacatacaatcttatttataatgctgcaattatggtagaagaggggattgggtatgcgatttgtttagaaaagttagtcaatattaatgatgaaacaaaaattcgctttattccattttatcctccattgttaactggaacagtaatcgtatggaaaaagcatcaaattttttcacctgctacagcgcgatttattgaaaaaataaagcattctctaaaagcatgattgattatagattataggtattagacatataatttctgacgatttataataacattgaaaagaaaggatgaattataatgacaaaacaagctgttgcaccacgaacaatttttatgacggaaaaggattttcagcccattgatgaaactagaatttattggttatcaagcgctggtgtgatgatcaatagtcacggtactactttgatgattgatccattattagaaggatttgatctacctttattagttgaaatgccaattttacctaaagatgtacctagtttagatggagtactgattacacattgcgataatgatcattttagtcgattaacctgtaaaaatttagctccagtgactaaatcatttcatggtcctcattatttagcagaattattcgcagaagaagatttaaaaggaaatggatatgatattggtgaatcatttgaaattggaaacatgaaaataaaattaactcctgctgatcatgcttggcaaaatgaaagtagtaagtatagtaaaattcgtaaatatcagtttgaagattattgcggttattggattgatacacctgatgggacgatttggatggttggagattcgagacttttacaagaacatctgcaaatgccagaaccagatgttatgttatttgatttttcagataattcttggcatatcggcttagataatgcgatcaaattggccaatacatatcctaatacagaattaattttaattcattggggaactgttgatgctccggaaatgaatgcatttaatggtgatcctaagtctttgaatggacgtgttgttaatccagaaaggattagagttgtagctccaggggaagcttttgtattaaaaaaataaaattgttagaaccaagttgtcattagtatagcttggttttttgatatatcaataatgctttttaggtattattgataatacaatataggtattagacataacaatataattaacttaaaatataagtgtatagataaggtaatggaggtgaaacatcttgagaataaaagaggtaagtaagagatttaatgtttcaataacagctttacgatactatgaaaaagttggtctatttgaagatgttaaccgtgttaatggtattagagaatatgaagataaagatattgaaagattaagtttaatattaacattgaaaaatattggcttgagcaatgaaactattttgaaatatatcgaattaaatgaacaaggggcacatacgaagaaacagcaaattcaggttttgaagttagaacgtcaaaagctattagatagtattcataatcaacagaaaaatatagattctttggattatttgatttaccagttaaaagataaggagaagataaaacatggtgagcaaaagtagtaaacattggttagttttaattgtatgttgtggtttagcggcatcttcaataggggtttcaattaattcgtcaggtgtcttttatacacctgtttcaactagtcttggaattatgcgtggaacattttctatgcatatgactatcttttcattaacaacagcaattggggctttattcatacctagaattatgaataaagtatcttacaaactattactgacaattagtgttgtaatagcagtagttgctacaggattgatggcagtaactaaatcaattccgggattttatctgctgggagctatcagaggacttagtacaggtatgttttcaattgttcccttaacaataattattaataattggtttgaaaaaagtcatggtttggctactagtattgtctttggattcagtggtttagcaggatcgatttgttcaccgattttatcaagctttattgaaaattttggatggcaaactggttatttaatcaaagctgcaattatattaggattatgtttgcccgctgtcttatatccatttcaccttgatccacaaaaagatggttgtttaccttatggacatgtggagcagccacaagatatggtgacacaagtgtcaaattcatttagctttacaacagttgcatttattagtttctttgtcttcggattattatgtagttgtattactagtgttactcagcatttacctggatatggtcaatcattgggctatagtgctgcattaggagcaatgcttttgtcatcgggaatggtaggaaatattatttccaaattgattattggagttttaagtgatcatttaggggcaattaaagcaactgttacaatgatcatagctaatactgtaggaattattttattaatgtggggttcaacagcgtggctattaattattggagcatttttgtttggttcatgttattcaattggagcagtggcattgcctttattaaccaaatacttctttggaatagataattatgcaagagttttcccaaagatttcttttgcttctaatttaggagcagcaatttctttatctatggtagggtatatatatgatttctttggctcttatttatatgcatttatcattgctctagcaatgattgcagtttgtgtaattactttaacattaactgccaaaacaaaagaatagaggaggaaagattatgaataagaaagcagaacagttatttagtgatttaaatgatggaaaggattttttagtaaaggatccagaacttcgggaaattatgattaattatctttatggggatgtctatcaccatggtaaccttgattttaaattaagagagcttattttaattgtcgttaatactaccaatcatactttaaaggctttaaaggaacatgtgacaagtggcttgagtgtcggagtaacacctgtagaaattaaagaagcagtatatcaatgcactccctatataggattaggcaaagtagaagaagcattagaaatagttaatcttgtttttgaagagaaaaatattagtttaccactattaccacaagcaacggtacaaggtgataatagatttgaaaagggatttgcagttcaaagtgctgcatttggacaagagcatattcaagcaggtcacgaccatgctccaaaggaattaaagcacattcaaaattatttatctgaatactgttttggagatttttatacaagaaatggtttggatttaccaacaagagaattgattacaatggtgatgttagctactttaggaggttgtgagaatcaattgcgagctcatgttggggcaaatctaacagttggaaataatcgtgatactttaattgaaacaatcactcaatgtcaaccgtatataggatttccaagaacattaaatgcaattgcaattattaatgaaataactaagaaataaaaatggaggaatgtaaaatgaatcgtgaagaaagtttaggaccatctgcagtatttgaattaggagaacctaatgatgcgtatgcaaaatattttattggtcaaagttatttgaaacatctaacaacagaaggagttggtgttgtcaatgtcacatttgaacccggttgtcgtaataattggcatattcatcataaaggtggtcaaatcttaatcgttactggtggaaaaggttattatcaagagtggggaaaaccagtacaatgtttaaaaccaggtgatattgtaaatattccacctgagataaaacattggcatggagcagtaaaggatagctggtttagtcatttagctgttgaagtgccggctaaggatgcttctaatgagtggtgtgaactagttacagatgaagaatatgaaaaattataaaaggagataagacaatggaatatgtaaaattaggaaatacaggtttagaagtatctaaaatatgtttaggttgtatgagtttcggggatcctcaacgttggatccatagttgggtactgaatgaaactgattctcgtaagattataaaaaaagcattagatttaggaatcaatttttttgatactgctaatgtttatggattaggggccagtgaagaaattttaggacgagcgcttcaggagtatgctaaacgggaagaaattgtaatcgctacaaaagtaagcggtcaaatgcatgaaggaccaaatgggaaaggattatcgcgaaaagcaattttgcatgaagttgaacaatgtttaaaaagattgggaaccgattatattgatttactttatattcatcgctgggattataatactccaattgaagaaacgatgtgtgctctaaatgatttggttagagcaggaaaggttcattatttaggtgcttcatcgatgtatgcctggcaatttcaaaaagcacagtatcttgcagaaaaaaatggatggactaaattttctgtaatgcagggtcattataatttattatatcgtgaagaagagcgagaaatgattcctttatgcaaagatatgaaagtagctttggtgccttatagtccactagcggcaggacgattaactcgtgattggaattcagattcaaaaagagctcaagaagatttggttgcaaaacgaaaatatgatagtactgtagatacagatcgaaaaattgttgaaagagttgctgaaattgcagataaatatcaagtcactaaatctcaagttgctgttgcatggttatgggctaaaggcgtgactgcaccaattgtagggattacaaaagaaaaatatttagacgattttgcgggtgctttaacagttaaactaacacaagaagatatagaatatttagaagaatgctatcagcctcatgtaattatgggacataattagaaaggatgaaaaaatggtgaaaaaattatatttaatgcgtcatggacaaacactatttaatcttcaaaataaaattcaaggctggtgtgattcgccattaacagagttggggcagtatcaagctaaagtagccggacaatattttaaagatcatcaaattacttttgatcatgcctattgttctactagtgagagatgtagtgataccttagaattagttacagatatgccgtatacgcgtttaaaagggttaaaagaaaatttttatggtcaattagaaggtgagagtgaaaggttaaattgtcacttgacaccaaaggattgcgaaactttctatttacaatatggtggagagtcttcaaatacagttagagatcgaatgatgcagacattgacaaatattatggaacgagatgatcattttaatgttttagctgttagccatagtggagcttgctttaactttttaagagcaattcaagatccaactgaagaattaaataaagggtttggaaattgctgtatttttgtttatcaatttaatgatggagtatttaagttggaagaagtaattagacacaaatataattaaaaatatccacttcattatgaagtggatattttttcatttgcacagcaagtaggttaactgtcattcctgtattgctaaccaacaatattttcatcttaagtatctttattaatgatagataaaacgttgggatatttattgcaagtatgctcactgtttagaatggaaattatgttagtaataaatttatttttaagttagctttacagcgattgataagtggtaataaaagaatcaaatcatctttgttattaatatttttatttagagtgttaatatcaacagattctatttttagttttccttgatttaaatcaaggaatttttgtatgttgtaagcaaaaaagaagaagtaaatccctagctgcaataaattaaaacttttttcaagtattatcaatacatctaaaatctttcattgttttcataatattcatttggaaatttatcttttgcccactgatacataaccaaatagtttacttgttttaaaaagttattcatattatctcactcctttatctatcattgtgcttattatacaaaaaatgggaacagattatagactctttaaacattatggaatatttttgcagctttttgattaaagtagttagaagaatagaaaaaattttttcaaaatttggtatagtaacaaaaaagataggataactgttataatttagtcattaatagaagggagcttgaaaatgttttgtgattatcatgtacatacagagtatagcgatgattcttgctatctaatggaggatgttattagggatgcaatcgttttaggtattaaagaaatatgttttacagatcatgttgattatggaatcaaattagattgggatgatccaaatttaataattaaagagaatgaaaagactattgccaatgtcaattatccacagtattttcaaaaaattgattctttaacagagaaatattgtaaccaaattacgataaaaaaaggaatggaatttggaatacaaatgcatactattgataaatttcaaaaactttttaataaatatccatttgattttattattctttcaattcatcaagttgaaaataaagagttttggactaatgattttcaagctggactaagtgaggctgaatattatcaaagatactaccaagaaatgtatgatgttgtaagaaactatcatgattacagtgttttgggacatatggatttaattaaacgttatgatgataaagatggttatgatgccttcaatgaacacaaggagataatcactaggatacttaaatatattattgaagatggaaagggaattgaattaaatacatcttcagttagatatggtcttgatgatttaatgccatcacgtgatatttttcagctatattacgatcttgggggaagaattattacaataggtagtgatagtcacgaaaaagttcatctaggtgctcatattgaaacgatgaaaaaggatttaaaaaagattggctttaaagaattttgtacttttaaacaaatgaaaccaatttttcataaattgtagaaaatggatttttaatagtccatttttatattaattttattttaaaataatggtgataatctaaataatttaagctatagaaagaaataaagatgggttaccgcatataaaataaaagttttagagagatttttagttattgatgaaattaactaatgctcaaagagaaaatctccaaattagcagtttatattggaagaagtttaattatgctttgaaagctgctctgttatcatgatctgataattggataaaatacttgggttcactttactaggtatcttttttattagctataactaattatatataatataatgaaataaagggtgataattatgagctatttatttgatagttatgcaaagatatatgatcattttatgcgcttgtttcatttagatgatacaagtgttattgaacacaaattatcgaaggggcaatatcatattttggatgttggcggaggaagtggaacactagccgctgatttacaagctgctggtcatcaagtcacaattgtggattctagtttatcaatgcttaaagaagctaaaaagaaaaacactaatgtaaaattaattcatgcatcgatacaaaaaggtcttccaataaataaagtcgatgttatcatttgtcgagattgtttacatcatttaatgaatcaagaaaaatgtcttaaattgatgctaaattatctaaataataacggttttattttgattcatgattttaatcaaagagcatttagaataaaattactttttctttttgaacgttgttgttttgaaaaaataaaaccagtcaaacctgaacaattggttgatttttcgcttcaaaataagctgaatatagtatttctacatcaaggaaagtgggactatatatgcatgttaaaaaaagaaaaataattagtttattccatttaggaataaaggtaggatatttatttataacaagaaaaattgtgactagaagtgatattggcaattcttatgatctggttagtaaaacttatcagcaagaatatttaaaaataatgcatacatataatgatattcttttaaatcatctaatcaaacatatttctaaaggccgtattctagacttggctggaggaactggttataattcaaattttatccaagaatataatgattattcaattgatcttgtggatatttcaaagcaaatgttaaaacaatgtcagaattcaagcattaataaagtgtgtaaaggaatgcttgaatttttaacagtacaagaaagttgttgctatgatgcaatcgtatgtacttgggcattgatgtacgaacaactacaaaaagtattaaatcaatgtcagcggttattaaaaaatgggggatatttgtatatcttagtaaatgatcagcaaacattgccacaaattcgaaaaatttatccaaaattattaattgaatatgtaggctcaattaataaattaatgtttgatttaccaatgccaaacaatgcgcagcaattggaacgttgggctaaaaaagcgggattaaaaaattgtcgagtaacttcaaaaaaacaagaattttatttcacagattggaatcgggccgcaaaatttgttacctcaacaggtgctttggctggttatgatgcaatgttggatttgaaaaatgaaaaaatttttaatactcttgttgagcagctgcagaagttttttactaaaccatgcattactcatcatttcgtgatgggaatatttaagaaggggtgacctgagtgaacaaacggatgattattaaaatgtgtatcaatcctcacattattaaaacatttttaaatttgcattgccaatttcgcaagcatgaagattataaggttagaaatatggtaaaatgtggattaaatataattataaatgatcatttagtccagcatgatggttattatttagtgaattcatttattccaccgattaatactgaagcttttaggacagtagttaagatggttcctggtaaaggaaaaaatttttttgttaatcacactgaagggattcggctggctccgatttctacatatattgctgttacagataaatgtatgtaccattgctggcattgcagtgcatctaagtttatgaaagatgccacatcaaatagtcaattttcgactttagaattaaaaaaaatcattgcccaattacaaagattaggtgtagcaattattggttttacaggtggtgaacctttattgcgtgaagatttagaggagcttattgcaagtattgatgaacgtagtgttagttatatttttacaaccggatataaattaacttatcaacgtgctctggctttaaaagaagcggggttatttggtattgcaataagtctcgattctttagatgcccaaagacataatggaatgcgccataatgatcatgcttacgattatgctgttgaagctattaaaaatgctaaaaaggcagggctttatacaatgagtcaaacggtatgtacacgagaattactgattaatggaggaattttaaagctggcactgtatttaaaaaaattagaaatagatgaaatgcgaatcatggagcccttaccttgtggtgctttaaaaaacaaattggaagaagttctaactgataacgaaaaagaacaattaaagcaattgcatattacattaaatagagattctcgatatcctaaagccagtgtctttccatattttgaaagtgcagaacaatttggctgtggagctggagtacagcattcatatattgatggacatggtaattttggtccctgtgactttattgagccgacatttggaaatgtgttgaatgaaaatattcaatatatttgggtaaaaatgtcaaaagcaataaatggcccgcattgtcaatgtattgctaaaaattgtgatatttgtaaacaattacctcgattttataaactaatgcgaggttataaaaaatgagaaagcaagtgacttatttaggaaatattctttgctatgaaattgaaaatttaaataaaccagtctgtatttgttttcatggaatgaatatgactagagaaatgtataaaacagatcaactgcaacatttattaaaaaattattctttggttttagttgatttatgcggatatggggattcttcgatagaaacaaagaattttaatatggtagtatttaatcagctggtattaaaattagtgaagtgcgaaaatatcaaatcttgtactattgttggatattgtttagggggtgcatttgcacttgattttgcgattcgtaatccatattttattgagcgtttaattttgatagaaacaatgatttatttaccgaaatggttatggttgacactgttgccaggatactgcagcggctatcgaatatttcaaaagcagattaagttatttaaaatattagaatgttgtacgaaattcaaaaacattagttcatcagaacgaataagaatatcgtcaagggaatggaatcgtactgttaattcattttatttaaagcttatgaatgagtatgaaaaacaaaatcatattaagcgatgtcaacaaatcaactgcccagttaatataatttatagtcaagccagttttaaaaatattcgaaaaactgcgcaaatcttatcacagttttcatttgtagaactccatttgtgtcaaggcagaggtcattttttgtttcttgatgagactatgaatagaatagtgatataaaggctggaagggaagaaataatgcagaagaaaacaattattatgggaatagtcatatgtctattagggattggttattttttattaaataagccttgattatctaatgaagatggagaattatttaattatctacttaatggttataatcctgatttgtcaatcacagaaattatagttcaagagggggaagaaagattatttaatctctttacattaattgacgaaaaatctaattatggtgaacggtttaatgattgtactctggtagagcaaaatttttggtttctctataattttcatatggaagtagaatgtggggggagttgagcagtttatttcaaattattatcatcattctgattttacgcttgaagcttttagagatttggaactaacgataagtaaagattatttacaagctgcaattaatatctatccaaataaacgaatcgagatgtactcaaatcaagaaatcagtaatcaattagatcaaattgatgaacagtattatgctgatcatgaaatagaatattttgattttattgataaatacacagaagaaaatattgtaaagatggatgaaatcatgtttaaaattggagcgttttctaaattaacataggctactgttagaatgttaagatattatgatgaaatgggacttttaaaactggctgcagttgattaaacaactggatatcgcgccatgtattcaagtgaacaaattcttcgcttaaataaaattatatatttgtaaggtagtggatttaattaacagagatagcacttgttttaaataaccaaggaaatcagtttattattgaataactggagcaaaaatatattggaggaacaagtaaaattaaaaaatcgaattagcaaaaaaagaattattaggtaataaaaatgggatgaattataatgttctaataaaataaactccaagttattttgtactttcatttagaaaaataatttctgattattatgctgaaagtaagttgtaggaagaattattaaactttactgctgagcatagaagagatgtttcagcaaaatatttttcaatttattatgatgaagattaccgtgaatatgatgttgatgtagaattgtgagtatcaattagaaaagctgtcactatcgagaagctttttaaatttcgatacacctcagctgttgaaataatggcttgtatggtgatatatggagatttttctaatattgctgatacttatttatcattagtaaattggttacaaaaaattctcagtataagatttcaagatccaattgctttaagtgttgtagaagtcatcgcaatagattatcaaacagagatagttagtatcccttatattgatatcaatccatatacaccaaatcttgaagaatcggcttattttgcatgggcggatgaatttgatttttaatcattttcaaaataagaaatggtagcaagtttgtaaataaacttgctaccatttttgttatttatgaaccgtgaccacactagtttttgaaagataatcatgcaacatacgatgattagaattaaggaggctcataaacattgaaataaacgatactattcctaaaattgataatgcaaatgaagctattgatgcttcaaagataatgtttatcagttcccaaaaatagattgagcagctataaaatgtaccttcaattaaaattaatccaactccatttctaattaataaagtttttaaatcaatattaatttcattattcttaacaatttttaaaccaaagatttttttaccaattgtttgaccattatatttgtaaggaaaataaactaaatatagtaaagagagcagtaagcctattaaaaatgcactaattgcgggaattagaggaagattgacaattgaactagtaaaattcttttgatgatagataatgctataaattaagtttataggtaaaattgtcatgacactgatgatataccagtcaataaaatatgcaattagtcgtttaacaaatggtgcttggtgattatgtactgatgaatggttaaatattcttttcatgattgacgctccttaagaatcttcttataattttagtatagacaattcttttaaaatatccttacagaaaattactctaagcttggcgaaaagactgcaaggacaaataattattaatagagtatatttattatggataaggagagattatgatgctaaatgaacgacagaaacaactatttttatgcttagatgagaataaaaatagttttattaaagggattgaattagctaataaagtaaattgtagtttgaaaacattacaaaatacagtaaaagagatgaaaataattttagaaaaatatcaactagaaattatttcaatgacaagcaaaggatataatctgattatccatgatcaacaagaatataatgattttaaacagttattattagaaagtgatgataaaaaagattttaataatcagggttatcgaattacatatattttaagtacattattatctgataatcattttgttaaagcggatgatttggctagtcaaatgtatgtttcacgatccagtgtttcaagtgatttaaagatagtcaagagagttctcgaaaaatatcaattaaaaatagaacataagcctaattatggcatgattgttgttggcttagagaaggataaaagagattgtattattaaagagcaattagaattgcaattaggacattcaacaattaaaaaggaatggctagctactataagtgatatagttgttgatagtctgatgaaagcaaaatatcggattagcgatgtggtcttacaaaacttggttttacacatatgtgtttcaattcaacgaatgcagcatggaatatacattgataatccacaaatggcaaggcaatatgggcatgagcatgtaattgccaaaaaaattttggatgaattagcttcaatatatcattttattgttactgaaaatgaaatatcttttttagcaattcatctacttggaaagcgtagttatgaagaaaatgatttaatcagcaaagaaatcgattattttgttaatggcatgttggaggaaattaagattaaaactgatattgatttttatggtgatgttgaattgaagatttcattggctttacatctggtgcccttattagttcggctagaaagccaaatgcaattacaaaatacaatgattcaagatattcaggcgaattatcctttagcgtatgatgtggcagttattgcggcatcgtatatcagtgaacaaaaacattatcaactaagcagtgatgaggtaggttatttagcagtgcatttttctttatcgctttcaaaaaaagaaaataaaattaatcctaaaaaagtcttaataatttgtaatgctcgtagaggcgattatttaatgattcaacatacttttttaaaagagtttaatgaaatgatcagtgatttagagattatcaatgcgttagagataccacaatataatttagatgattatgactgtatttttgcaacatttttgaatcatccactgattcctaaacgagctttaagaataaatttttttattgatcaaaaagatattcaaagaataaaaaattctttacaaggtcaaagtgaagcaggtgaattattaaagtattttaaagaggagtattttatgggcatgattgatgccaaaaatcaaaaagaagttattcaattgatgtgtgaagttgcaaataaatataatgagtttgaagaagacttgtttcaatcatgtattcgtcgcgaggaattaggcagtacggcatatggacagctgattgctttaccgcatcctgatcatttgatttctcaaaaaacgattgttattaccgctattttagataaaccgatcgtatggtcgaagcaaaagacacaattgatttttttgatttgtgttgaaaaaggaaatcaaaaagatttaagagtattatttgagtgtatttcaaaatttatgatggatcagcaaagtgttcaagatgttatttgtagaggtgattatcaaacttttacaaaaaatttaggaaaactgattggataagggggagagaaaagatgaatgaaacaagttttgaattaattttacattctggaaattctaaatcatcttcgatggaagcaattgaatatgctcgtcaggggaatattcaagaagcagattttaaaatgaacgaggctcaagaagagttattattagcgcataaaattcaatcaaaattgttagctaaaagtgcaaaagtagaccattttaatccaaatatgcttttagttcatgctcaagatcatctttgtggggcacaaacacaattagaaatggcaaaagaaattattagtctttatgagcaagttcaagaaataaaaacatatttaggtatagaaaattttcaaaaacaaaaaaatatgcgagtattgcttgtatgcggacaggggatgtcaacaagtttgttagtacaaacaatgtatttatatgctgatgaaggggattatattgaatcatcatcatttgaagaactagtaggtgtgataggtgattatgatgttgttttggtgagtccacagatccgttatcgaatgcctgtaattgaacgaatgatgacgctgcgtacacaaatagtaggactaatcgatatgaaagcatatgggaagttggatggccaaaaaatttataatcaagcaaaagaattatttatgaaaatcaagcattagagccagagtttgcatagaattgctctaagtatagcgaaattatgtgtaaggtaactttcatttataaataatataatgtaattgtaaagaaagggaggaaactattatggatagatttacacaaatgttagagaaaactctaatgccaattgctgagaaggttgaacaaaaccgttatttaagtgcaattcgtgagggcttcacgagcatcatgccttttttaatcattggttcaatattcttgttgttatcaaatttaccttcggaagctttaaataattttttaggaagtatttttggtgctgaaaatattgctaagttgggttatttgttagaaccgacttttaatattatggcactgcttgtaattattggaattgctaaatcattgttagaatatcatcatattaaagatacaagtgcattgattttaccaattattacgtttttattgttaaataattttacaattacattgacaactgaagctggtgaaacagtcacttcagggggagttattcctatgggatatcttggagctgcaggtttgtttgttgcaatgatttgtactattttgacagttgagagttatcattggatcaaagaaagaggatgggtaattaaaatgcctgattctgttccgccggctgtaagtcgctcattttcttcattaattcctgcggcaattatcttaacagtagtatttttaattaaagttatttttgaatatacaccatatgcaactgtatttgatttaatttatcaatgtttacaacagccgttatctgcactaggaaattcattgccatcacagatgatcagtgaggggctaattggtttattttggtgcttcggagttcatggtgataacgtcgttagtgctattatgggtccaatttggcgcggtttatcagcagaaaatctagctctagtccaagctggtaaagagccaattaatattatttgtcaacaatttagagatgtatatttaattgcaggaggaactggagcaacattatcattgcttgtttctatttggtttggggcaaagagtccagaattaaagacagttgctaagttatctggaccagctgctatatttaatattaatgaaccggttatttttgggatacctattgtcttaaaccctataatgatgataccatttgtaatagtaccaatagttttatgtgttacgacatatctggcaatgagtttaggtcttgtaccattattacaggggattgagattccttggacaacaccagtatttatttctggctggatagcagggggatggaacgcattgattcttcaaattgtcaattttgctgttgctactgctatttatttcccatttgtaaaagtgttagatcgtgatttattaaaaaatgctaagaaaaaagaattgctacaagaataggaggactttatgcaagtttatgtatttaaaaccgaacaagatgttgatacatatgttggacagcaaattagtacatttattcaagataatgatgctccagtgattggttttgccacggggtctacaccattaggagcatacgactatttaattgattcataccaaagtggaaaaacagatttttcaaaagttagagcctttaatcttgatgaatatgttgggattgaaaaagatcatcctcaaagctttgcaagagcaatgaaagattatcttttcagtaaaattaatattaaagaagaaaatatttattctttaaatggaaatgctaaagatatgacaaaagaatgtaaagaatacgatcaattgatcattaataatcctatcgatattcaaatattgggaataggaatggatggtcatattgcttataatgaaccaggtagttcatttgatagtgaaagtcatgttgttgatttacaccccgagtcaattcaaagttcattggattatggttttacaaaaattgaagatgttccaacgcaaggagttacgcaaggaatcaaaacgattatgaaggcaagacaactaattatgattgccaaaggaaataaaaaagctaaattagtggaaagaatgttatatggtccagttagtgaagactttcctagctctataattcaaacacacaataatgtaattgtagtattagatcaatgtgcagcagccaatttgaaggaggaaacttatgaaaggcgttaaaatcgttacaattggaggaggcagcagttatactccagaattagtagaaggatttattaaaagatatgcagaattaccagttaaagaattatggttagtagatattgaagagggaaaagaaaaattagaaattgttggtaatctggctaaacgaatgataaaaaaagctggacttgatatggaagtgcatttgactttaaatcgtcgtgaagcactaaaagatgctgattttgtaacaactcagtttagagtcggacaattagatgctagagaaaaagatgagttgattcccctaaaatatggagtgattggtcaagagacaaatggtccaggtggaatgttcaaagcattaagaactattccggttatttttgaaattattaaagactgtgaagaattgtgtccaaatgcttggatcatttcttttacaaatccttctggaatcaatgctgaagcagtgtttagacatactggctggaaaaaatttattgggttatgtaatggacctgtaaatatgatcaaagacattgaaaaaattttaaaagttaaagaagaagaccatttagatgttaaaattggtggaattaatcatatgatctatgcattagatattcaattaaacggtaaaaatgctaatcgtaatttgattgatacgatgataaatgatggaaataaagaatctttaaaaaatattgttgatttaccatggagcaatgaatttttaaatagctatggttatttagggattggatatttacgctattatttacaaaaacagcaaatgctggaacattgtcaagaggatgcagctaaacatcaatgtcgtgctcaagttgtgaagaaggttgaaaaagaactatttgagaaatataaagatgaaaatttggatgtgaagcctaaggaattagaacaacgtggtggagcttattatagtgatgcagcttgcaatttaatttcttcattatacaatgataaaggagatattcaagtagttgacacactaaataatggtgcaattactaacttacctaatgatgtagtcgttgaagttagtagtattataactaaagatggacctgttcctatcccagtaggagaattaccagttcaagtagttggattaattcagcaattaaaggcatttgaaatcttaactaccaatgtggcagttagtggcaattatgatgatgccctagttgctatggcaattaatccattagttcaaagtgaaataacagctcgacaaatactcgatgaaatgttagaagcacacaagaagtatttaccacaattttttaaataaagaaatttaagtaagaataaactattagttagtttattcttatttttgttttataaataatattttgtaaagtgcatgaaggtgttttattatgcttattattgtgatgacagtttaacgatgatatacttagtaaaaatagggagggaagttatgaaactaattattgaacatctacaaaagaattttgaagataaaaaagttttagaagatatcagtttttgctttgagaaaggaaaaatctatggtttattaggtcgtaatggagctggcaaaacaactttgtttaattgtttgaaccaagatttagaaatagataaaggcgatttttatcttgaagataatggccgtaagccattaacgatgagtgatattggttatgttttatcaactccaacagtaccggaatttctaacggcacgagaatttttaaagttttttattgagatcaatattaagaatataaaaaatttaaaaactattgatcaatattttgatatggttaatttattggaagaagatcgtgatcgtttattaaaagatttttcacacggaatgaaaaataagatgcagatgttgattcagttcattgcacaccctgatgttctattgttagatgagccgttaacatcattagatgttgttgttgcagatgagatgaaaaagcttttaaaaagtataaaaaaagagcatattattattttttcaactcatataatggagttggcagttgatttatgtgacgagatagttatccttaataaaggacaattatcattaattaataaagaggatctggatgatgatgcttttcaagaaaagataatcaagattttaaaggatgaagatcatgcttgatacctttctaatttcatttcgtttgaaaaatacttatcgtgttaatagcattatttatatgtttaaacaaattccaattattagaagagtgttacctatgtcactttataaaaatcaaagtctaaaaatatttgttactatcttaaatactatttgggaaattatatcagtttttttaggaaaaataatatattttgcaattatgctcataatacctttgaattttatgaatgtatttaactttcgtgcaatgttacaattattattttttctaagtttaggcggagcattttttaatacaggaatgtttgatccctcgaaagataaatattatgcagttattttaatgaaaatggatggacgagagtttgtactatcacaatacttatatactctgttccgacattatgttggatatatgacagcattcatgattttatcttttacattacaataccctttttggttaagttatatattaccgttatttattattggtttaaagctaatggctgttagtgcttatcttaaagattttaaaaggaatcgaaaggtacgaagtgaaaataataattcaccagcaataattggatttagtatcggatgtttattagtgggttatgcacttattttttctaatctgattattccgattaagatgatgctgattgttttaataatccttagtatattagcggttattttgatgagttatgtattaaagtatgatgattatcatcagcttagtcataaattattaaaaaatatcgattcgttattaaatacagatactcaagatattattaatgattcatatcataaaatgattactttagaggctgatactaaaagtaataaaactggttttgagtattttaatgaattatttatgcaaagacataagaaaattttatggaaaacagctaaacgacaaacttatatgattgcatttataatagttgtgataattggtatcttattttatgatgttgaaactcaaaaagatgcaaataatgctatgacaagtattttacctttttttgtttttattatgtatttattaaatactgctaaaaatattacacaagcaatgtttgtaaactgcgatcattcaatgttgacttattctttttatcgaattcctaaaaatattttaatattatttaaaattcgtttaagagaaatagttaaaatcaatttattgccagcagttgttttagcattaggatatatggctattttatttatttgtggaggaattgatcaagcatttctggcatttatatcttttatctcaataatttcaatgagcatatttttttcaacacactatttaatcttatattatttattgcagccatataatgcgcatactgaagtaaaaagtcctatttattcaacaattatttcattgacctatattatttgttatgcttttactaaacttgagttaccaattctttcctttggaattgtttgtattctattttgtattggctattgtgtcattgcttgtattttagtacttaagtgggctgggaatacttttaagattcgaaattaaattaactaaattgaaagtttagtttgatgatgatattatttatttatagatataagtagataggagggctaaaaatgggatgttgtagaagaaattttaatactgatgaatttaaagcatggctatccactttacacgaagaacagccgggaactgaattttgtatcaaagaggatgatcaaaaagagacatataattatcttaaagataatctttttggacaaattgtcgtatggaataattcggttgtagaagaaatcatcactgatcgtacaaataatgaacaaattttttatcttcattatgagatggaagatcgtaatcagattaaagaattaattaaaagttttaagcgaagaatgttttgtgtttgccagaaagagtatgaagtgagtgaagatgatggtgaacgaaatattttactgtgttgttctagtgggttaacaacagcaatgtttgctcaaatgttacaagattttagtaataataatcatttaccataccatttttcagccactattatctatgatgatgatacgctatcgaaagaatatgatttagtgttgatggcaccacaagttcaacactatactaaaagtatggcagcgaagtatcacaaacgttttttaataatgaatcctgttgattttgcacaatataattgtaataatattgtttctcgtgtgcaggaagtatttttataaagactaaattttgaatatttatgactcactgtatattatagtgagtttctttaatattaaagtcgtatttgttattaattattaatcgtttagattatcaattgagcaatgatggcatggttaagaagataggctataaaggcaaaaaaattagttagaaaagatgtattaatttaatttttaacttaattattatataatataggtaatggattatttaatgtttgataaaaggaggtaggaataataatggaattaatgatttcacggattttaaaatatttaaatgggtgtttagatgatgatcatatgtataggattggtaattttataattaaaaattatacattgatagaaaatcatactatggtatcatttattgatgcagcaaaatgcagtcaagaagaactcttggacttttgtcaacattttggaatacatagttttgatgaatttaaagaacgtcttttagccgatcatcagggacgtcttgaacaaattcatgcgcggatgttaaacactgatataaatgatttccttgagcatgtaaatactgattattctaaggaagaatttatacagtggattgatgaactttgtgaattgatttttaataagcagagaattgttattcttggagcgctatatccaagtagtgtagcagttgatttccagacagatttaatttcattgggaaaagaagttgttgagtatcatcattttgatttgaattttgagtttagtgatgacgatgttgtcttctttattacagcaactggtagaatgatggaaagaaatgtaaaaaaattaaagccacaaaatatttgtgatgcttatttggttctaattacacaaaatctggcatatcgtgattatgagaatgtttgtgctgattattttgcgcatgttcttggtaaatttgatggtttgcaatttaattatcaaattatgatgatttttgatattttgcggattcgttattatcaaaaatattatcaataaagattatatcattaagatatgatctttttttataaaataaattaaattggaatgacaatagtatttttaatatatgttaaagaaaaaatattatttctttaactttataacgactctaagtggtataattatagaaatatatagtattaatgatttaggattaatttatttggattcttttttcttttaattaactttagtaattatgttgatataaactttttattgaaaatatttttgttaatcttcagtttatttaagaggagtagaatttacttattattgaaaaaggagaaaatcatatgcttcaaatacagaagataactaaggaatatattactggagatttacatcaaatagcattaaatggtatttcgttaaatcttcgtgataatgaatttgttgcaattcttggacctagtggttctggaaaaacaacacttttaaatataattggcggtttagatcgttatgacagtggagatttaattattaatggtatttcaacaaagcgatataaagatcgtgattgggattcatatcgtaatcatacaattggctttgtttttcaaagttataacctaattccccatcaaacagttttagctaatgttgaattagcattaacaatttcaggaatttccaagaatgagcgacgtaaacgagcaattgatgctttaaaggaagttggactcggagaacatcttcataaacgacctaatcagatgtctgggggacaaatgcagcgagtcgcgattgctcgagcattagtaaatgatccggatatacttttagcagatgaaccaacaggggcgcttgatagtgaaaccagtattcaagtaatggaattactcaaagaagttgcccgggatcgtttggtagttatggttactcataatcctgaactagccgaagcttatgcaactagaattgtagaattacgagatggaatcattcgcagtgattctaatccttatgaagttagttcagataaactagaagttccaagacatgaaaatatggggaaatcatcaatgtcttttttaacatcactgttgttaagttttaacaatcttcgtacaaaaaaggcacgaacgattttaacttcatttgcaggttcaattggaattattggaattgccttaattctttcactttcaaatggggttaatcaatatatacagtcaattgaagaagaaactctttcagagtatccattacagattcaaagtacaggttttgatataacgtcaatgatgactgatacacagcctaatcagaataatgaggaaaaagatgatactaaaatacatgtatcacaaatgattacaaatatgttctcgaaaataggttctaatgatttgacttcattaaagaagtatcttgatagtggaaaaagtaatatcaaagagaatactaattcaattgaatatacttataatgttgcgccacaaatttacagtactaatactgatttaattcgtcaagtaaatcctgataagtcattttcatcattaggactaggctcatcagccaattcaaatagcctaatgtcttcgatgatgagtacggatgtattttatcaaatgccaagtaatacaagcctttatgaagatcaatatgatattaaagctggaaattggccaaagaattataatgaatgtgttctagtgttaactaaaaatggaaatattaacgattttatgctttatactttaggcttacgtgattattcagaacttgataaaatgattgaacagttttcaaaagaagaaaccgttaatgtgcctacagatattaagtcatattcttataaagatattttaggaatagagtttaaacttgttaatgcctcagattattatcaatatgatagtaaatataatgtttataaagataaaactgatgatgaaaattatatgaaaaatctgattcaaaatggcgagaatattaaaatcgttggaattgtacagcctaaagattctgccagcgcaacgatgttacaatctggaattggatatcctgcagcgttaactaatcatgtaattgagcaggcagcttcaagtgagattgttaataaacaaataagtaatcctaatattgatgtttttacaggaaaagaattcagtgataaaaatagcaatcaattagatatgaactctttatttactgtcgatggagagatgatgaagaaagctttttcatttgatcaaaataaactttcttttgatatgggagatttagatttaagtcagattaaactggattcagcttctttaccgagtattaatatggataacatttttgctaatatgaaagtcgatattcctaaagagaatattgagagttttacgcaggcagttatgacacagtttcaacaatatttaaaagataatggattaatcgatccaactaaaatgaatgaatactttatggcatttttacaaactgatcaggctcaaaaattaatgcaggatgagatgatcaaacttctccagtcaagtggggcaactgaacagtttcaagctcagttggaaaggcaaatgcaaacagtaatgactcaatataccgaaacgatcactaaatcattacaacaacaaataagtacacaaataactgagcaaatgggaaatcttgctaatagtatgcaagatgcgataaagattgatacaagtgtttttgcccaagcgataaaaatgaatatgaatgaagaagagctctcagaattaatgatgtcattaatgaccactgagtcttcttcatatgaggggaatcttaaaaatctaggatatgctgattttgataagcctagtgcaataaatatttatcctaaggattttgaaacgaaacaggaagtaatcaatattttagatagttataatgaaaatattaaaaagattgatgaggataaagtaatttcatatactgattatgttgggacattaatgtcttcagttacagatattataaatgtgattagttatgtattaattgcttttgtcgctatttcattagtagtatcttctattatgataggagttatcacttatattagtgttctagagcgaaaaaaagaaattggaattttaagagcgattggtgcttctaagaaaaatatttcacaagtctttaatgcagaaacttttattattggattactagctggagtattaggaatagggataactttgattctacttattccggggaatgcattaattcatgaaatagctggtaatactagtgttagtgcaacattaccaatcatgggagcaattattctaattgtattaagtgtcttgttgactttgctaggtggtttgattccgtctaagaaagcagcattagaagatcctgtaacagctttaagaagtgaataggatttaaaagagtttccttaacaagaaactcttttatttttgtatttattgaaaagtataataatcaagtgataaaaaatataaaaaaacaaaaatatttattaaatcaatattttttaatctctataatgataattgtcgatagaatgaaatacgtatttcaaaaaaaataaggagaatatatggaaaagttagagaaattattgaatagatttattggaccaatcgctaagaagatgagtgagaatgatacaattcagtctgtagcagaggggtttatgagaactgggcctgtcacttttggagtatgtatatttgttattttggggaatttaccctttactggttattcggattggttaacaaacgttggtcttaaagtacattttgatgctatttcaaatgctagtttaaatattttagctttatatgtttcatttacagttgctcattcttttgccaaaagaaaaggcgataatgctttatcttgtggaattttatcattattaagtttcctgattataattcctcaaacagtagctggagttgaaggggatataacagcttttgatataacctatttaagcggtacagggattttagtggctttgatttttgctattatcgtaggacatttgtttcattatttagctggtaaaggattaaaatttaaaatgccagaaggggttccaccaatggttagtgaatcttttgaaccaatttttatatcaatgatcatagttacttttgctttcgtagttcgagttggttttggttatactccatttggaaatttcttaagttttttcgatcaaacaattggagccttcattattaaaattggattatcattaccgacaatcttcttattatattttgttgctaatttattatggttctttggaattcatccaaatacggtatatagtgcatttgtaccattacaaatgacactaattatgacaaatattgctgatgctcaagcaggaaaaccattaacttatttaacaatcactttagtttcactgtttgcatcttttggcggtaatggtaatacacttggattatgtttatcgatgtttacagcgagaagtgagagatataagaagatgctaaaattagcttttattcctaatttgtttaatatcaatgaaccattgatttttgggatgccagtaatgttgaatcctgttttctttattccaatggttttctgtaatgttgtaatgggctttattggtttgtttgcaacccaaatttttacatttacatacaatccggctatgtcattattaccatggacaactccattttttgtaaaagcatttttagcaggaggaatttcattattgatcatggtactaattttattggtagtaaatactttaatgtattatccattttttagaattgctgataagaaagcctacgaagaagagcaattagcgaaagttggtggaaaaattgagtaagttaagtaaagattttttatggggaggtgcaattgctgcaaatcaggctgaaggagcatatgatgccgatggtaaggggttatctttaatggatattgcgactagtgccagcaaagatgtttcacgacagtttacagatgggattaaaaaaggaatttattatcctaatcatgaggggatagatttttaccataaatataaagaagacttagctttatttgaagaaatgggtttcaaatgttttaggacctcaatcgcttggagccgtattttccctaatggtgatgaaaagcttcctaatgaattaggtttaaaatattatgatgatttatttgatgagatgattaaacgaggaatggagccggttgtaactatttctcattatgaaatgccgttatatttagctaagcaatatggtggctgggctaatcgtaagttaattgatttttatttgaatttttgtgaagtaatttataaacgatatagtggtaaagttaaatattggatgacttttaatgaaattaattcagttatttttatgccggaagtcgcaggaattattggccgtgaacaagcagattttaaacaacgaagttttcaggctgcacatcaccagtttgttgctagtgcgaaagctgttaaattgggacatcaaattgattcaaaaaatatgattggatgcatggtattaactttgatcaagtatcctcttacagcaaaacctgaagatgtgctattagctgaagaaaaaatgcgttatggaacatttgcgtttagcgatatacaagttcgtggacattatcctaattatgtaaaaaaactaatacaaaaaatagatttaaaaattgaagtaaagccggatgatttaaaaagtttgaaagaaggttgtgttgactttgttggattttcatattattcttcatcggctgcatcaacggatactaatgttgaaacaacagctggaaatatagtttccggggttaaaaatccatatttaccgactagtgaatggggctggcaaattgatgccaaaggattacgatatatcttaaatcgattttatgagcgttatgaaatcccgttatttattgttgaaaatggcctcggatatgatgaccaggtggatgagaatggctatgttgaagatgattatcggattacttatttaaaagaacatattaaagaaatgaaaagtgctattcttgaagatggtgttgacgtaattggctatacaccctggggatgtattgatcttgtctctgcagggactggagaaatgaaaaaacgttatggttttatctatgttgatcgtgatgatcagggaaatggaacattaaaacgtagtaagaaaaaatcatttgcctggtataagaaagttattgctactgatggagaagatttatgaatatagcagtttttgatgtcggtggtacatttattaaacattgcctgatgattgatggtaaaataacgcaagctggcaaaataccaactcctcaagatagtcaagaaagtttcttaaaagcaattaaagcagttttagataaaatgagcaatattgaaggaattgccttttcgttgccaggggtcatcgatgtttatcggcagtatatttatgcgggtgggagtctaagatataacgatcactgtgatttgaaagaatgggaaaattattttaatttgcctattcaggctgaaaacgatgctcggtgtgcagccattgcagaacttgaacaaggaaatatgcaaggcattcaaaatggtttagtacttacttttggaactggggtaggtggtggaattattattaatggtgatatttttaaaggaagtcatttgattagcggcgaagttagtatgatttttgcacatagaatcagtgatgtaactaatcatcatctttttggagcattgggtagtattaaaaacctaattgataaaatagcagctgctaaaggtgttaaaacggatgatggcagattgatctttgattggatcaaaacaggtgatttgattagctgtgagctttttgatgactattgtgatgatgtgatttggcagcttcataatattcaatgtatcctagatccacaacgcatttgtatagggggtggagttagtgaaaatcaaatttttattgatggaattaagacggcagtaaaacgattttatcaatcattgcctattccatttcctcagccagagatcgttaagtgcaagtactgtaatgatgctaatatggtaggcgcttatcttcactatttaagaaaaaacgatgagagataaactttcatcgtttaactatttttatattgaatagggctttttccaacaatttgtttaaaaactttattaaagtgactttgacttgagaattgtaaaatatcagcaatttgagctaaagagtattgagagtttttaattaaaaattgagcttcttggatttttttatgattaatgtattgtttaattgattgaccggttgtttttttgaattgggttgataagtaagtagtattcatctctgttaccttggctaaatctaataaagtaatattcttatgtaaattatgagaaatatagtttttgcaaatttttacccaatagggattttgaatatttcgataacgtttaactaattgtgtaaaatcaatgattgcgtcagaaataagtttgtgaagttgattaatagtattagactggtcgactttaacaatatacacatcacttaacgaataagctttatcgacaggaacaccgatactgattactccacgagtaaataccgcgatagctgcaacaactttatatttagctgactgaagctgatttttagataaatgacgttcatctttgatttgaagcagttcaatcattaagattctagcactggtactatcctcattttgaatataatttagaattttttgttcataagtataactaaattcatgcaaaggtgtttcgcgaatttgaaagatttctttttcaagagaattttcttgttttaaaggattatccttagaacctttaaaagtaatttttagtaatttagaatcaagaattttaccagtaattatttgataaataaaaataaaatgattttttgtttctacagtaatgctggggagattaaagaaatcatctagcgtatacgatgagattacatgttgaaataactcgtactcagcaggtgaatcttgggttgttatttttcgattaaaaataggtcctacacaaatataaggaatttcatctagcttagtacaaaaaaagaaatatgtggcattttgatgaaagtgaatatatatttcatgctgtttcataattgtaaaattgaaaatttgttgaaaataatttatttctaattttaaaaatttttttggagaagcaatgatctttaaatcaggagaaattaaaaatagtggagtatttaaattttgataaatagtgggaagtagattgattaattcttgtttcgtttgaatcataaaatcatcctttcaatattattgtataatgatttgtttttagaagatataaaattttaagaaaagaggataaaaaatgtttaaaaataattttttatggggtggagctactgctgctaaccagtttgaaggtggttataatttaggaggacgtggccttgcgacatcggatactaaaacaaatgggtcaatgaataaaaaacgaaaacatagttttttagattctaatggtaagattgtttatttacatggtagtgaaaaaattccccaagcttatcaaagtgttattgatgagaaaatgtattatccaagtcatagagcagtggatttttatcatcgttatgaagatgatattgctttacttgctcaaatgggttttaagtgttttagaatgtcaatatcatggacacgtatttatcctaggggaaatgaaagctcacctaatcaagcaggtctagatttctatgatcatatttttgacgagtgtttgaaatatggaatagaaccaattgttactcttaatcattttgatatgccaatttatttggctgatcatcaaaatggctggttaaatcggcaaactgttgaatattttatacaatattgcaaaactgtttttaaatattatcggggcaaagtaaaatattggatgacttttaatgaaattaatttgttaaggggatatgatacattgggagtacatgaaatgacccccgctcgctactatcaagccttacatcatattttcgttgctagtgcaaaagcagttattttaggacataaaatagattcaaataatcaaattgggatgatgttggcaaatattcttacatatagtgaaacttgcaatcctagagatgttgctttagaattagatgtttcgcgtaaattaaaatatttttacagtgatgttcaatgtcgaggatattatccttcttatattgtaaattctttaaaacagcaagggataacgattaacagtttagaagatgatgataaccttttaaaaaatggttgtgttgattatattggttttagctattataattctggagtagtaacaactcgcaaggatgccgaaatgacattaggcaatggtattaaaatggcagcaaatccttacttaaaagaaagtgagtggaaatggccaattgacccgataggattaagaatttccttaaatttattatgggatcgttatcaaaaaccattatttatcgttgaaaatggtttaggtgcaaatgatcaaattgctgaagatggaaaaatccatgatgaatatcgcattgattatttaagagaacatattattgaaatgaaaaaagctgtagatgaagatggagtagaattaattgggtatacaccatggggatgtattgatttagtttcagcgggaactggagaaatgaaaaaacgatatggttttatttatgttgatatggatgataatggtaaaggaacattaaaaagaagctgcaaagagtcattttattggtatcaaaaagtaattaaaagtaatggcgaaagcttaagctagctttaattgtaaaaaatatgatataatttttatacaagttttttgggaggataatatatgttgttgaaacaaatgaaatattttattagtgtagtcgagtgtaatagttttacagaagcagctgaacaatgttatatatctcaatctgcaatttcccaacaaattaaagcattagagcaggaattaggtgttgatttgatcaaacgtaataatcgacaatttaccttgactcctgctggtgagtatttttatcgtcatggagtggagctggtaagcgaaatagataatttaaagagagaaactgtacgtcgcggacaagatcaggagttatctttaaagataggatatttaagatgttatggagctcaagaattacatcatgcaatcgctaaatttagcaaaacatattccgaggtatcactatcaattgttaatggaactcatgaggagttatatgatcttttacgctctggacaagttgatttggtaatcagtgatcaacgacgagcatttaatgatgattattacaattatgagttattgtatagtgattgttatattgagatttcaagtcggcatccattaaatcagcgggatattctaacaattactgatttaaagagaaatacctgtattttaatttcaactaaagaacaacaagaggttgaaaaagatttttatcaaaatacacttggttttgctaatcaatttttatttgctgatactttagaagagggacgtttaatggttgtaagtaatcgaggatttatgccaattgaagcagttggaacattaccaccacctgcgactggaattacacgaattccactttatcaccatcacaagccattacaacgtaattattgtgccttttggcataaggaaaagactaattattatattgaagaatttgctgaattactacgtaatttattaaataatgattaaatatggcttattatatttttagaactctttggagttcttttttcatataagttttacttatgagaatgattagcaattaaaattgttatagttttattaatattttaaaatataactgtaaaagaaagggtgagtaagatgaaaaaaagtttgattgtatacttttcgcatcggaaagaaaattatgtagcaggtgctattaaagatttaaaaatagggaatacggaagtgattgctaaaaaagttcaagccataataggagcagaattatttgaaattcatcctcttcatgaatatccgtctaaatatgatgagtgtacaaaattagctaaagatgaactagagactaatgcaagaccaaaaataataaatattattagtcattttgaggaatatgaaaatatttatcttggctatccaaattggtggtcaacgatgccgatgtgtctttggacttttttagaaagttacgatttcaccaataaacacatatatccattttgtactcatgaaggaagtgggttaggtaaaagtattagtgatttaaataaaatttgtcctaatgcaataattcatcagggattggatatttttggtagtcaagtatttgacagtgacgaaaaaatatttaagtggttaaaggagaattgaaatatggcaataactaaaaatgctcaaaactatcatgaacgaatgtttccaggctatgagtcaaaattattaaaaacagatccagaatttattgaattatttgataatttcgcatttgacgaagtagttaatcaaaatgatttagatgataaaacaagtatgattgcaattttagcaatgcttctaggctgccaaggtattgatgaatttaaagcgatgctgactgctgcgtataattttggtgtaacaccaattgaaatgaaagaaattatttatcaagcaacagcttatttagggattgggagagtatttccttttttacacgtagttaacgatttttgtactaaaaatggtattactttacctttacaaggacaatctacgactaatcaaagcaatcgtttagaaaaaggaatacaagcacaggttgatatttttggtcaagatatgtgtgaattttataaaagtggaacagcagatataaaacacatcaattattggttaacagataattgttttggagattattatactagaaaaggcttagattacaaacagcgtgaaatgattacattttgctttttagcagcacaaggagggtgtgagccacagttggtatcacatattgaagcaaatattagattagggaacgatagagcttttttaataaaggtgatttctagaggaattccttttcttggatatccaagaagtttaaatgctttacgttgtattaatgaagtaataaaataatttaaaaagtatatgggattccatacaaataatgaggaggtaggaaaagtgaataaggaagttatgatcgtaaccggtgctggtcagattagtatggctattgcaagaagacttggatatggtaaaaaaattattattggtgataaaaatattgataatgctaataggattacaaagataatgaatgatgctggctttgatgtaataccagttgaaatggacttatcatctagaaagtctattttaaagatgattaaggttgctcagaattatggggaaattagtatgcttgttaatggagcaggagtttcacctagtcaagcatcgattgaaacaattttaaaagttgatttatatggaactgcagttttattagaagaaataggtaaagtaataaaagacggtggagttggggtgacgatttcaagtcagtcaggtcatcgaatgccagctttaggagttgaaattgatgaaatgctggctattacagaaacgaataaattattggacttagaagtactgcagccacataatattcaagatacacttcatgcgtatcagcttgctaaacgctgtaatgaaaaaagagtaatggctgaggcaattaaatggggacaaaagggtgctcggataaatgccatctcacctggaattattgtaactccattggctattgatgaatttaatggtccaagaggagatttttataaaaatatgtttgcaaagtgtccagctgggcggcctggaacggctgatgaagttgcaaatgtagcagaactattgatgggaccccaaggagcatttattacaggtgcagattttttaattgacggtggggctactgctgcatatttttatggaccactaaaaccaaaaaataaaagttaatttaaggagaaaagtatggaatatgtaaatttaggaaaaacaggattaaaagtttctaaaatatgtttaggatgtatgggatttggtgaattagatcgtgggggaatccctggaaaaactgcagaaaaagaagctcgagaaattattaaatatgcgctagaacatggtattaacttttttgacacagctaattattatagtcttggtgcgagcgaagaaattcttggacaagcattaaaagattatgctaatcgagaagatgttgtaattgcaactaaattgtattacccaatgtttgatggtgttaatgcaaaaggattatcacgtaaagctgtttttacagaagttgaaaattcgctaaagagattacagacggattatatcgatctgtatattattcatcgctgggattatactactccgatcgaagaaacaatggaagcgttgaatgatttagtaagaatggggaaaattcgttatattggagctagtgcgatgtatgcttggcagtttgtgaaagctaatagtattgcagaaaagaatggatgggcaaaatttattagtatgcagaatatgtataatttagtgtatcgtgaagaagaaaaagaaatgattccaatgtgtcaatacgaaaatattgctcttacaccattttcaccacttgctcacggtgtctttaataaggcggttgatactccgcggacagatggctgtggtaaactgcaaaatgattatcaattagctcatgattgcgaaatcattaaaagagtttatgaattagctaaaaaatatcaaaaaccaactagtcaaattgctttagcatgggttttaagtaagccatatattacatcgccgttagtaggtagctctaaaattaaatatttagaagatgctttacaagcactagatatcgtcctgaccccagatgagatagcatatttggaagaaccatatgtgccacacaatcaatatggttttagataattaatagaaataaaagattatgaacttatccataatcttttattttagacttaataaaccccttgacttaaagtaaagttgaagggctatgataataaaaagaaaattaataaaaaatgaaagaggaagcctatatgaaaaagatagtcgttatatcatcaagtcctagaaaaaatggtaatagtgaaattttagctgatcaatttatcaaaggtgcgacgagcgtgggacacaaagtaataaaaatcaatttagcaaattatagaattgctccatgcctagcttgtgaatactgtcgaggacatcacaataggtgtgttttaaaagatgatgcgaataaggtaattgaggaaattgttaatactggtgtatttgtaatggcaacaccagtttatttttatagtttgagtgcacagcttaaaattttaattgatcgtatgtttgcacgtgaatatgaaatcagaaatagccctaaacgaaaaacagcttatttaattttaacaagtggaagtactgatcgtgaacaaatgcatggaacaattgaaagctttagagggtttattaaggtgctcaaaaaggtggatgaaggaggaattatttatggtttaggagcatttaataaaggtgatgcttacacacacccaagttatgatgaagcttatcaaatgggttcaacaatataattaattagatttcttatcaggaggaataaaatagaaaattattataactattttgtaaataaaggaaatcatccaaataaactagatattttaaaagaagaacataaatatatttttgaatattttaatctccagactgctgctttgattatggataaaataattgatgaagctaaatattataatcgaccatttgctgcaagaatagtttataacaataaaataatcaggcgatgttttgttaatagttataatgaaaaaagtattaaatggttaggccgtaaagagcgggtatgtcttgaaacaaaacattcctcgtattttatttttcttgataatatagatacccataattataatcaaatgatttttgatgaagaatatggtctttgtgggggaagttttcctatatttataaaaggagtaccagcaggggcaattactgttactggattaagacctcatgaagatcaccaagtcattgtaaaagcattggaaaagttattttaatcagtcattcattagggtcaattatgatatttttaagaattaagaataagatggatatagtttttgatgccaattgatctaaaaaatagataatgtttatttaaggtgaaaacaattattatagctacagttttaggaatgatcattaatgactattttttaccaaaaccaattcttaattttatattgattggaatgatactttcagctgtttttgcaaatatgtttagtgagtctgaactatcttcactaatgcatgagtttaatccaatattatgaattgcacgattaggggtaactttgattaggtgtcctgctacagtcattaaatatcttggttttacactattaccacattcttgagtatctttagtatttactggaattgctgtttcaactccagctgcttagattattcaaagaacgattgctactgccgcagtgattaatgaattgattggtgtaatatttgcaaaaaaaaaggttttgaatgggccggagaattaacatataaaaaggtttaggcatattctaagaatacgcctttgaaattttttgaatcagttaatgctttgctattaagagtttaaaatagttagatattctttcatgtgtctttaaaaaatataattgggaaatacgtttcattaagaatagaataaaggttgttcttaataatatcaagaataatttttaaatcattatcagctaaatttatgttatgattagtatatattttttaaagactgtaagagaaagattttatgatcaataatttataagtttccaatttggcataagcattcctctacttttttataaaatgcttatcttaactgtatatttatactatactgttaagaaaataaaacaacaatattcaatatctttagatttatttaatcatagataaatttgtaatcattgtataaaattgggaggaataattatgccaataaaatatagaaataccctaagatctaaagctttgaacaaagaggtgcttattgaattattgaagaagaaacctacacgtaagattatagtcactgataatattaaaagtgctagtattagtcgtaggactttttatgcacattattaagatacaatagatttgtcagaaagctttcaaaaagaatttttggcttaaccaagcagctttactgaaaaaataaaggacgaggattaaatgataaaatagatctattactcaatgaggtaataagtatcttaaaaaagattatgaaacatataagattttagtgaatcaagatttttcattttctttttatcaagatattaagaaagttattattttacaattattaaaagagtattcatgtagtcaagaagttcgacaaactttaaatatttttattttagggcttgttgtgttattgagagaatggttagaaaatcctgatcttgaatcgatggaggaatatgggaaaaacttttcttgtcctcataaaactatttttagtagtaaatctagtataatttagatattttcatagttaattatgataattcagacataaatttttttatttagaaaaaaagttaaatacattttaattaatagtataatcgtattaattataaaaatattggagggtattatgacaaagaaaattattttttttgatgttgatggaactttagtagatgttcgaccatcacaagaatatattcctgcttcgaccgttaaggctgtccaagcgacaagagctaaaggaaatttatgttttttgtgtacgggaagaagtaaagctgagatttttgatcatatcatggatgttggttttgatggaattattggagctggtggtggtttcgttgaaattggagatcgaatgttatatcacaaacaagtttctcacacagcaatcaaccatgttgttgattattttgaggctaatgaatttgattattacattgaaagtaatggtggattatatgcaagtaagaatttaattccacgattagaaagaataatgtatggggatttggaaaatgatccagttgcacgtagaactaaagctgaaactcctaatcattttattggatcattaaaagaaggttatgatcttcatcgtgatgatgttaataagatttgttttttggaaaaagataatttcccttttgaaaaaataaaaaaagaatttgagcaagagtttaatgtaattcattgcactgttcctatttttggtgataacagtggagagttatcggttcctggagttaacaaagcttcagctattaatgctttgattgatgagttaggtatccctaaagaaaatacatatgcttttggtgacggattaaatgatgcagatatgctggaattttgtcaatatgggattgcggtaggtaatgctaaagaggcattaaaagaaattgctgatgaagtgacagacgatattaaagatgatggtatttataattcaatgaaaaaatatggtttaattgactaaaaagtcctacgttatgtaggatttttattttaaagactctaaatgaataacttaaatatgttataataaaggagttattaaagggagaaaatgtatggaaagtaaaaataataatttaaaagatttgattgtatctggaagttatacagcttttattaaaggcgatgactggggatgcggtgtcaataaaatattgctaagtctcgatcataaaattgatcaggttaataatctgagttttgtggttaaagagaagaagttgactacagattattgtgatacgctatatccgattattgaaagtattatttatagaactgtaacaaatgtttatttagtagactatagtggtcaaataactagtgaaccatctaattttattatgatagaaatgaaaatcagtccagcagaaggaaatccattattgttttcaatgcagacacaatataatacatataatgatttatatgaattggacatcatgatagctgatggacatgaaatgacctcattaggtcaaaaagttaaacaaataaatattgctaaaaaaatgaaagataagattactagtgcagatctgtttgaagaagcgttatatgaatcttgtgatggagtgagttataaatatgctgcttataatcctgtgcaagcaagtgatactttggttgtttggttacatgggctaggtgagggaggaacaattaatactgatccttatattactgtattagctaacaaggttagttcattagcgggtcaagagttccaaaatacgattggtggggctaatattctggtacctcagtgtccaactttttggatggataaaactggtgatagtttagcaactaaatttacggaagcagatgggacttcatattattgtgattctttacatgaattgattaatttttatcgaaaagaaactaaaagtgagaaagttattatcacaggatgttcaaatggtggctatatgacaatgttgatggcacttaagtatggtaaagaatataatgcctatgtgccaatttgtgaagcttttttaaatgaaaaaatatctgatgaagaaattaaacaattaaaaaaattgccaatattctttatttattccagagatgatgatgtcgtagcccctgaaacccatgaattgccaacgattaggcgcttgttaggggctggggccagcaacgttcatacttttgtttcaaagcatgttattgatacttctgggcgttttaatgataaagatggagagccattacgatatagtggtcattggtcatggatttacttctttaataatgaggcagtatttgatcgttgtggaattagagtttggcaatggatggcacaacagttaaaataatctgtaaaggtaaaaaagatagtatctctaaaaatggatgcattaattcaaataaaagggttgttgtctatatttaattagatacatttatttttttagtagattaatttttttgttactctgataaagacatatttattgattattactttaagtttattcgttgaatcgtttattataactatcgcattttacgtttttttattatatgaaaagatttattagtaatgtttacaaaagaatattttgttaaaaattagggtaatactttatattttattgtatataactaaaaaattattaaagatagataaggaggataaagatgaaaaagaagtatagattattgacatgtttattggtttttatgttggggttaactggatgtactacagatggttataatattccgcaaccacaagctgaggttgttcctgaacattctgatttaaattttgaagatatgagctatgagagaccagatattgatgcaataaatcaaaaaataaatgatttattagcgaaggtagtgctagaaggaaatcaagaagaaattttaaaaggatatgatgaaatattaaatgatttaaaagaggttgatcaaatggagtcattagcatctataaaaaataatattgatttgtcagactcttattatgaagaagaatgccaatttcttactagtgcttttgtgaaactagataatcgtatgaacgaattaaccgaagctattttgacaacttcatataaagatgcgtttgttaaaaagatgggagaagattttatcgaacgttatgagaagaataagaaactcaattctccagaaattgaggaactaagtgaacaagaaacagcgctgattaatgaatacagtaaaactgctgctaaagaatatactacgatgatcaatgggcagagtaaaacaattgatgacttagattttaataaacaagaagatattgacgggtattatgatatttatgaacaaaaaaataaagagttaggaacgatttataaaaaattagtcagtattagagttgaaattgcgaaaaaattaggatatgaaaattatacggattatgcttatgatttgttaggtcgagattttagtaaagaagatgcagaaaaatttgaggaagcagttttagagtatgtggcaccactagcagcaaagatggatacaaaatatcaagaaaaattacaaaaattggatactagtgaaattacagtcgaatctggtttttcatatttaaaaacagcattaaaacaggaatttcctaaagcaatgcaagatgcttatgattatatgcaaaaacatcacctttaccaaattgatgacgattcaaatatgctccatgctgggtatacgacaattattgggaatgagccatttttatttattaatacttcagactacaaagatccttcaactttatttcatgaatttgggcattattacaatttttatttgatgggaggaacatcttggaatgatggtaataatctcgatattgccgagattcattcacaagcatttgagctgttgatgtttgaatattatgatgaaatatacggtagtgatgcaaaactaatggagataaaggttattaatgatatgttaaatagcatcttacaaggatgcatagaagatgaatttcaacgaaaagtttttgaaaatccagatatttcattagaagaaatgaatactttacatggtcaaatttatcaaaaatatatgggttatcctttagagtatgaatgggtcgatattcatcatcattttgaaacgccgttttattatattagttatgctacgagtgcagtttcatcattagaattatggttagtaggtacaaaaaatcgtgaagatgcattaaatgcatatcgcaatatgactcaaaacactctcaatgttgattacttagatgcattaaaagactcaggtttcagtaatccttttacatctaaagtaattaaaaatatttcttctgaaataaaaagagaatttttataataataaaaagccatttatttagatggctttttaattgaagaattttttggtttgttttttgttggtgggcttggttttattggttgaataggttttattatttttttcattataactagactcctctgtttaattatagcacagataaaaatgaaaaataatcagtttgtttaaaaataaatagtcaagataattagatgactttaaaacttttccattgcccttgtaaataacgtactaagataagagcagatttaatagcccaatcgccaaccattgctaatgcaattccaattacaccaaggttcatccaaaccccaaaaataaatgataagatgacacgacacacaacagttgaaaaaattgaagtatacatcgtgtattttacgtcaccagctgctctaaggccatttgataatgatgaggctatagggcataataaggcattaaataggttatgaataaaacataaaataataattagtttaatcgtttcgttcgataaactatacaatttaagaatgataggggtaaataggaaaaatacaatattccaaatgatcccgccaatataagtgattcttaataattttttcatataatagtccgccgcttctttatcaccggctcccatacattgaccgataacagtgataaaagctggtcccattgcaatacaaaaaagagcggccattgaccaaaagctttgtgcaaccccgtttgcagcaatctggctagttccaaacattgcgacaatactacttaaagcaactttagataattgaaataagccattttcaatgccgttgggaatagcaatatttaggatacgcttaatcatttgagcattccatttaaaaatatccttaatgcgaatataaataatatttttctgattaaaagatataattaataaaattaaagccgcaacgactcgagaaattagtgaagggtatgcgactcctgcaacacctgcatgaagaataaaaattccaatagcattaccaataatattaataatattcatgatgattgatacatacatgataacatttgttttagacatacttctaaacaatccggcacaactgttatagattgctaaagcaggaaaagaaaaagcagaaataactaaatattttaagcaggcatccattacatctggagcgacttttccaaacaataatgttagtaattgttctcgaaaaataaccgataatactaataaaataactgaaattattgttgttatcataactaattgactagctgctaacactccattttccttgtttttattaccgatatattggctggcaacaacggcaccaccagatgctaatgcagtaaagacaagaatgaagaccgtattcaactggttgactagtgagacaccagatacggctgcttcaccagcataactaaccattagagtatcagctatcccaactaataagatcaataattgttcaatgatcaaggggatgattagagctcgtagatgcttatttgtaaagatttgccgttttttatctaattgtatttttggttcaataaatttaaacatatatattcctccgtttttcatataatacaacctcgacttgactctaagtcaattgttttttttatataatgaagaaaataaaaaagagaaactaattgtttctctaataagatttataaaaaatcctgacatgaaactaaaaggtctatttttgcccattgagttttttcatcaatacagtttccctcttcaacagaggcgaagccacattgaggtgataatgcaatatttttaccaataattctttttgcttcaaaataacgtgtttttatttcatcatatgtttctagtttaggatttttagttgaaattaagccagctacaaaagtaacattagtattttttaatcgtgcccatggtgtaaatgaacctgaacgctcatcatcatattctacaaagaagccatcatatgggatttgacaaatgataggggcaacagtatcatataaaccagaaaaaagaggatagcctttaaaatttcctttacaaaaatggttagcaatggtcatgtcaataggtttattttctaatgcttttgtagatacttttctaaaccattctaaaatatcttcttttttgtatccaagtgagcttacttttaaaaggaaattatcatcaatcatataggtccatgatgtatcatcaatttgtaaataacgacaaccatgatcatataaatctttaattgcaatttgaaatgcttttccaatatcatcgataagagcatcaatatcaccattataatatggtacctcttttaaacctaattgaagaaaatgatcaactaagatcatatttggtccagagatacattttttggcctcaattccaggatattttgttactaggttgaataagtagtcccaagcctcgatttctggatgatatttatctttatcataggttattttaccgttgatcattcctaattcaatgtgatttgttacaccatttctcgttttatcaagatgttgagttgtaaagccattaaattcttttaaccagtccaaatgccaccatcttcttctaaactcgccatcagtgacaatttttagtccatgagcaacttgtttatcgacaagtttagcaatttcatcatcttcaatttttctaagtgtttttagatcaatctcttgattaaaatattttgctcgtgcttctttgattttttcaggtcttaaaaaagaaccaacaatatcatattttatcttcaacatatttttgttctccttttattttaatataaatattataaagaaaaatggcatacttttataatactaaaaaaagctgtttggctataggatgaagctatagtgaatatttctaattgacttatagttcactataagttttataattgaaataaagtattatttgaacaattatggaggagtattaagatgaaagtaattacaattatagtaccatctaatcaatgtcatttattgattaaggaattagaagcagattattttatttttaaaaaatttgataattatgaaattatgcaggatttttcaattttattgctaaatatttatgattatcaatataatttaatagaagctgcactaaaaaaatttgaaatgataaataagcaaaaatgctgtctttgtattagtaaataatttatattatctttaaaaaaattcttgcgctaaagtatgctttaaggcttataatagttttgaaaggaagggcaaaatatggataataagaaattgggatttggtttaatgcgtttaccttcattggatcctaatgatccagcgaagattgatattgaacaaacaaagcaaatggttgatctatttttggaaaggggatttacttactttgatacagcttggatgtactgtggttttgcaagtgagaatgctgctaaagaagcattagtggaccgctatcctcgtgatagttttacattaacaacaaaattacatgcaggatttttaaaatcaaaagaagatcgtgatcgcattttcaatgagcagctaaaaaagacaggggtagaatattttgattattacttattgcatgatattaatacccatagtattgatacttataatgaattagattgttttaattggattgttgaaaagaaaaaacaagggttagtaaagaaaataggtttttcttatcatgatgggccggagttactggataaagttttaactgagcaccctgaatttgaactagttcaattacagattaattacttagattgggatagtgcaggagtacaatctcgtaaatgttatgaagttgcgacaaaacatcataagccagttattgtaatggagccggttaaaggtggaacattagcaaatgtacctgaggaagttacgaaaatgtttaaggactatgctccacaaagttcaattccatcttgggcgattcgttttgttgctagtctagataatgtagtcatggtattaagtggtatgtctaatatggaacaattgttagataatactgaatatatggctaattttaaacctttaaatgacaaggaatacaaacttattaataaagcagttgcagctattaattctactataaaaattccttgtacgggatgttcgtactgtacagatggttgtccaatgaatattaatattccaaaatatttttcattatataatgcagatttacaagaagtagcagaaaagggctggactccacaaggcgaatattatgcaaatctgacaaaaacgtttggtaaagcaagtgactgtattgcatgcggtcaatgtgagaatgtttgtccacaacatttaaatattattgaaggacttcaagaagtggctgctcattttgaaaaataggctataatagaagaattaaaaggtctaagttgactttttagttcttttatttttattatattcaatatttgcttattatcattacttataatagaataaaattagatgaggtggaaatatatgttgattgaacaaaaaatagaacgtgcaagattatctcaaagccaacaattaattgctgattatcttctggaaaaaagaagtaatataaaggatatgacaatcaaggaactagctgtagcaacatatacatcaacgggaacgattatcagattagccaaaaaattgggatatcatggttatgaagattttaaggctgattttttaaaagaagtttattatttagatactcattttaagaatattgatcccaatttcccatttgttaaaactgataatattcaaaaaattgcaagtaaagtaacattacttgcacaagagacattatcagatacattagctttgctagagcatgataatttacaaaaagctcttcgaattatgcagaaggccaatcaaattcatttagcggcaatttcttattctttattattgggacaaatttttaaattagacatgcttagaattggaaaaaatgttaatatttgtaacactaatggtgaagagttatttttacctgcggtaattaaaaataatgattgcataatcattatttcgtattcaggagaaattcataatttatgtagtttggctaggactttaaaaggaagaagcgtgccaattattgcaataacaagtttaggggataatgagctaaaaaaatatgctgatgttgtccttcatatttcaactcgcgaaaaattatattcaaaaattgctggatattctaatgaaaatagtattaaactaattcttgatattttgtattcatgttattttaatttaatgtatgatgataatttagctcgacgaattgcaatctcgaaacaagcagaggtgggacgggagtctacgttagagataatgaaagaagataatactcaaagcggaacgtaattccgctttttttatttcaatttattaaaaagcgtaatcttgatacaacatttcctttaattctttagtcttttaaaataacttgataaaatttataatgtcgaggaggaaataagcatggatagtaattttttatggggtggcgcaagtgctgctaatcaatatgaaggcggatataatttagatggtcgaggtcttagtattaatgatgttgagttgggagcaggacatggaaaaatcagggaaattcatgaatatgtgcataaagatacttattatccaagtcatatagctacagatttttatcatcattaccaagaggatattgatttaatggcggagatgggatttaaatgttttagaatgtcaattgcctggtcgcggatttttccaaatggagatgatttggaatgtaatgaagctggattagaattttatgataaaatatttgatgaattaatcaaatatgggatagaaccaattgttactttgcatcattttgaattaccgttatcattagtaaaaaaatatgggggatggagaaatcgaaaattagttgaattatcggttagatatgcaaagacggtcatggaacgatatcgaaataaagttaaatattggatgacttttaatgaaatcaatgcactctttttaactgatcgaccatggcatatggcaggaattatctatcagcaagatgaagatttaaatcaagttaagtttcaggttgctcattatcagctgctggcaagtgctttaactgtcatagaaggacataaaattaatcctaattttatgattggaaacatgttattatacccttgtacctatggggcaacttgtaatcccacagatcaagtgattgcccgtgaaaagctattaccaacatattattttggtgatgttcaggtgcgaggttactatacaaatacttgtaaatcttatttaaaaaaatgtaatggtcatttagtaattgaagccggtgatgaagaaattttgcttcaaggaacagttgattatattagttttagttattatttttctgctgttgaaggcgtagctgatattgagatggtagagggaaatttatcttctggcgggaaaaatccatatttaacaacgactgagtggggttggcagatcgatcctgttggtttacgttattctttaaatcaattgtatgatcgctatcaacttcctttatttattagtgaaaacggattaggagcgattgatcaaatagaaaaggatggcacaattattgatgattatcgaatttcatatttacaagaacatcttcgagcaatgaaagaagcaattgagattgatttagtaaattgttttggttatgcaatgtggggaccaatcgatattatttcggcgggtactggtgaaatgaaaaagcgatatggttttgtttatgttgatttagatgattttggtaatggaacattaactcgaactaagaaaaaatctttttactggtatcaacaagtaattgctagtaagggtaaaaatctaataaacacggaggataatgataatgttgaaacgagtttataatcaaaatagatgtacaggttgtggaatttgtacgattaattgtccacaaaaaattttaaaaatttctaatggtcattgtgtaatcacagattttgataaatgcactaggtgtcaaatttgtcaacaggtttgcccatatcttgcaattgagtttaaaaatgaagaaaagagtacttttcccgtgttattaaagggagtgacgattccttttcatacaggttgttatcaagggatgattgagcggctattggcagaggtttgtgaagcgatgaaacttgagaataaattagttatatttaaatcaaaagatgcccgttttgaaataaacgtagaaatttacggaagtgataattatcttaaagatgcgttagagtataaacataatcatccagaaaagatagttgttgtatattatactgatgaagagccatggcagcataaacaagcaatcagtgattttaaagaacttgataatacaccaattactatttttcacatgcttaattatttttctaatttaaaattaaaaccaacttctgatgaatatgctatagatctttgcgaaatactatgtatttcaaaagacgctgcattagttgctcgtggaagttttacagatattaaacgaattactgaagtaaagcgttatatgaaagaggcaattggacaccaacttgaagccaacggctatacttttttagaactaacattaccatgtcattggcggttattagataaacctcaaggtactattacatctttacaagtaatagaaaatattgagtggtttaaaaatattatcaataagatgtacccgttaaagaaatataagtaagataagattgactataaaacaatgactagatacgctataatgttatagtaacgatgaattatagggggactagatcatggatagggatgaggtacttaataattattatatgcaagaagatgccctagtaaaatatggattcaaacgtcttgataatctttttattgttgaaaaaactttgaaaaacaatgaattttatgctcgttttgaaataagtaatagttgcttcaacattgatgtgtttgaaaataacggtgaaaaatttttacctttttatataaaaaatgtagttgggggctatactgcactgataaaggaagaagttgcaagtttaacggatgaaatcttaaaatcatgctttaaaccaattagtattagaaaaaagatattagcttatgtaaatgataaatatcaaactgaagcagattatccgtggacacgtgatccaatgtcagctaccttaaaaatattagaaactaaaaaatggtatggattgattataaatatcccatatcgatgtttaaatattgataaagaaggaaaagtagatattttaaatgttaaaaatacacctgaaaaaatcaatgccttaattgatcatattcattattttcctgcttatcatatgaataaaaagcattggatcagtattttacttgatcgtactgtccagataacacaagtagaaaaattattagatgaaagttaccaactagttactaaaaagtaaaataattttataatttagtgaataataaaaatacatcagtatttatgatagatattttattaaagacatctcaatccgagatgtttttttggatatatgaaaaaataatgttttttaatttgatatagtgtaaaatataagatatttgagattagagtaatagtaataaggaatggagaattataaattatggttattgtattaattgcagcaagatataaaaaacttttagagtggataaacaatcgtaattatgaaggaattaaagcaatctataaaattaaaaacgttgggccaaaggtttttctttatattgatactagccttgatttaaaaaatattattaaaacatttaaaaagagtatcagtgaacaaggcgggatggcatatgtatatgaattctacggtatttataatgaaaaaatcgattataatgcttatatcagcaataaaactaaagatataatgcgttattatcaaacaaaaataaaagatttaacggataaggaattacatgattttttattaaaaaataacatagataacgatagtgattaaagactatcgtttttatgttatgtaagttattagtgtttatttcttttataaatcagtgaatagataatactaagaatataattaaatgcaagttgtgaataaaaagtagcaattttttcatctttttctttatgaggaataattatatgataattgctatatttgactaatggattgtcacagttagaagtaatgacaatgatcttgcagcgtttttgaaaaagaatttttaaacaggctttataggattcatttttatcataagtgataaataaacaacaatcatccttagtgattcctttacaaaaagattcctgttcattattttcagttgtcaaaatgaaaaatttaccaattttaactagcttatttataaaattcatcgctgtaattttagaatcaccaattccaaaaacaaaagttcgtggactagtatcaagaacttctacaatatcttctaattcagcaatatttaattcactgttaattagattaatgctatctttatagacatttgaaatactgttaataatttgccaggttggttcattttcttggaaaggtagagtgaaatcagtttcgttatttagatattttaaagattcgatatttcttaggtattctattttgaaatctctaaagccattaaatcctagttttttacaaattcttataattgttgtatttgacgaaaatgtttggttagctaattctccaattgtcatatttaagactagattgggattttctttaataaaattgatgacttcgatctcactttttgtaaaaagtttctcattacttaaattatcgattaaactcatttttacttactccttagaataaatttatgaaacaggaaataaagtctattattttaattattaaattattgtactttgtgatcatttcatatttaaaataactattattatttcttgtttgttatgattatagcattaaaggaaggggtttcatagaataaattcagctgatttgtattcctcccgattgaaatatgataatattaaattttttaagtatttatattggatactttatttttcatgatatgagtgattgtaaatatagaataactttgttatattaatttttgaaaagaagcatatagaagatgaggcgtttgctattttgggaaaggatgaaatgataatgattagagtaggagtgattgctgatacacatgacatattaaaagaagaagtgttaaatgaactgaaacaatgtgattatattattcatgctggtgatatagttgatataaaaatattggagcgtctacaaacaattacaaaggtatttgttgtaaaggggaataatgacaagctgagtctgaatgaagaagaatattttaatattggaggttattcattttatttggttcatcaattagacactaaaaaggatgttgatttttatatttatggacattcacatcaattagcatgttatcaaaaaggtagaacattatatttaaaccctggaagttgtggaaaaaaacgtttctcattgcccttaacatatattattttagatctatatgaggatcattatgaatttcttgttaaagaatgttctaaataattgtttttgataaaaagtcttgattgaatatgcattcagcaatttcaactaggctttttattatgcagaatataagatttttcacgttaaaatatcattgttttcatataaattatcaagttcttgttttaatgaattaaaaactccgtttgatgaaatcaaaaatatttttttgagaacatcttgctgcgaaactgtctggtcttgatattgatacatttttattgataaatttaggtgcttttttgtatcagctgggaataagcggtatatgtttttgttcatcatgtatatttaatacttctaagaactcattgatgtttggggtaggtattccgttgtattttttgtagtaattatgttgataaagttgtcagaaaatttagaatttttgaaatatattacatttaatactttatatgatacaaaaagtattttagaaggtagtggatataaaagcggattaatggctatgctgttaattgcaattattttatatataatcggtattatatagtttcaaaaaaagacttgccattataaaataataattagaaatttatggtagggggttaatcatttaaaacaaataaaaagacagtcatatgaatttcttttctaatagaatacaaaatgtatatttagaagatagtaagatatattgctgtcttttttatttaattttttgatttccaatattcaaatataggagcctctggtttgtcttttgaccagaacatttcatgtctttcaaaatagccaataactttttttgatgcatctttaacaggaacgaaaaactctctttctccagttttaccattaagaacttcaaacatttcttcttcaccagcatcggcgcgttctagaaattcttcaattcttttctttgaattttcattatgacaattgaataaactattgccaacttgaactcttgagccgtatctttgctttgcggttttattcatatagcgtacaatatgatttcgatcaacgaagactatttcataagcataagcatctaagatattatataagatttccattgttatttccattttatcacgtatactcaatttaggtcactaagttgagtattctcctttctgcccttatatacatttatatcatccagggccaatgatgatataattttattagcactgtggatttgtccctatttttctacagcttgactgtttagaggttatacctgccacagttctttttcaaattgttgattaagttaattagcactcgatgctttatgaacaacgtgaatacatgaagaaaaaacttgtggtcttactgacagtgcgaattattttatggaggttttttataacttatttagttggtatcgatattgctaaatacaagcatgactgcttcattcatgatcataatggtgaagccattcgtcattcttttactttcgttaataactagaatgggttcaatcaattgcttcttattcttaaattttttggataagaatcaaaaaataaaaataggttttgaagccactggtcattatggaagcagccttaaacaattcctcaaagcctacaattttgactttatggagattaattcttttttaatcaaacaattttccaaagcctcaactcttaggaaaactaaaactgataagattgattctgttttgattccttgatatcttacgaccgttgactacaaacctacttcgaaccagtcatagcaccttgcttgaaatctacaaaaatattaatgctaaaataaaagatattgaagcgggaatcattcagaaatgagtctggacaagataattttaaaggtcacatggcaaaacatggctcttctcatcttcgtcaaattatcatgaatgttgtagatacttttgcattaaacaatcctgttatatatgactatcaatcaaagaaggaaaacactggcgagttgcacagactcacgtttgctagaaaacttatccgtatcattttttacctagaaaaaacggcatggattttgattccaaattattaaaataataatcaatagttgtcactattaatttttttggagttgaaaaactcctttttggcgttatttgatatctatatataaatttttttataaatcgtttgatttacaatagttaatcacctcttactatttgattttaacaaatattcattatttttgatagtcattgtataaatgagagacatattaaataaaattattgactattattgtggctaagttacaatagtaattttaatttaaataaaagtaaataggatactaacatctttgaaattggtcaattagttttaaatactaaaatcatatatgtattttatattaactcttgtggaaataatggcatatgtgaatcatttttgatatatcacaaatttattttttatttttatatgtatttccccaatcagccattacgtcgattactggtcgcatactttcaccaatttcacttaaactatattcaacacgtggtgggacttctggataggatgttctaatcacgattccatcttcaaccattgactttaaggttgaggttaagactttttgagatattccatcaatttctcttttcaattcattataacgcattgttttgttaagaagatatttcagaattaataatttccatttgcttccaattagttcaacagttgttgcaactggacattctggcaagttttctttttttatcattggtcctgttctcctttagataagttaattttattataaatagttagagtcatttaagcaagatagagctaagccggtagttgtgttataaatctcatttctaacaaaaaagtgccttcttttttaatcaataattacttgatattataatagtagcttaaaaattataaaattaattctattgaaagggagaaaatatttatgaatattactaattttaaatggagtcttggaaaatgtattcattgtggaaaatgtttgaaggtttgtccaggcgatttgtttatttttgatgataagaatgaattaaaaataaaagaaattgattgttttggttggggtggatgttggcagtgtgatcattgtttggctgtatgtccaactggggcaatttctatttttaataaagatcctcaaaatagtgtaactttaccagattatcaagatgctgggaaaatgatgtcggcgttggttcgtactcgtcgtgcttgtagacgttatcttaataaagatgttgataaaaaaattataaaagaattaatggggagtattcaatatgcaccaactggtggcaataagcgaaagttagagtttaccattattgatgattgtaaagaaatggactattttcgcttattagttagagatgaaatgattaaattagctaataatggcatatatccacaagggtttgataaaacttcatataatcaaatgatggcatgggaaaaatcagttcggccagactctattttttgtggagcaccgcatattttgattcctcatgcaccaaaaaatattccttgtgctgttcaggatgttaatatggcagctgcatattttgaattgttatgtaatgcaaatggttgggcgcaatatgtatgagttatccattggcagttctaggtaatatgcctaatgtaatgaaattattgcaaattcctgaggatcattatattagtttaatggttgggtttggttatcctgaaattcgttatgctagaggcgttcaacgtgaggcaaatggtaaaattaaaagaattgtttttactcaagattaggatagtttattaaatttaaatatttttaatgaaataactacagttagaattataattgtttggtttttagaaaatttattgtaaaatatgagtgggtgattaatatgaatttagtagacctgctaaatgacagtaagcaatttaatgaaacgcaaaatataatttgtcagtatattttaaatcacagtgaagatgttgttaagatgagtgcaagagcattagcaaaagaaacttatacaaatgcttcaacgattatccggtttgtgcaaaagattggatatgaaaattataatgattttaaaattcatcttgttcatgatttaaaagaatatcaagctgctgatattaaaattacagaaaaagaaaaaagtatttcaattgttgataaaattagtgaactagaaaaaaatgtcattgaaaaaacaaaaaatcaattatcattacaacaaatagaatatatagcagaactcctaaagaaaactacatatattgattttattagtagtgatgcaaatgcatgtattgcagattatgcatgtcatttatttttcttagagagaaagatagctaacaattatacaacatcaaatcagcagctttatttaactttaactgaattaaaggagcatgttgtttttgtgattagccgtaggggagaagatgaaaagattcttaaagttgttcaagagttacataaaaataaggaaataaaaattattgcaataactgggagaaaagatagtccaattgcaagatattgtgatgaaattttatctgcgattcatattggctcttttgttgaattaagagatatgatttttcaggtttctgctcaatatattattaattgtctattttctttgttatttacagacgattatcagtcgattgttcaatttaatgacgaatatgaaaaaatatatttaaagtgatatgcaacaatgttgcatattttttacttattttctttaaattatgtcacattgtttctttctttggaaaaccgattgaaaataattaagttttaaattactataaaaccgtatatttaaaaggaggaaataaaatgttacacaaaaaactaaaaccattcccaagtgattttttatggggagcttcaacatctgcttatcaagtagaaggagctaacttaatcgatggaaaaggaccatcttgtcaggatgtcaaaaaagtacctgaaggaacttcagaacttgatgtgtgtgctgatcaatatcatcgttataaagaagatattgcattgatggcagaaatgggattcaagacttatcgtttctctatcgcttggacaagaattttacctaatggaactggtgaagtcaatccaaaaggaattgaatattataataatgttattaatgaatgtttaaaatacggtattgaaccattggtaacaatgttccattttgatatgccggctgctttagatgaaagaggaagctggggtaatccagaatcggttgactggtttgtaaactttgcaaaagttatgtatgaaaattatggtgatcgtgttaaatattggctaacgatcaacgaacaaaatatgctgactttagttggaccggtaattggtacattacacttgccggaaggatgcacaaacgaaatcaaagaaatctatcagcaaaaccatcatatgctggtagcacaagctaaagcaatggcattatgccacgaaatgattcctggagcaaaaatcggacctgcaccaaatatttcattagtttatcctgcttcttgtaaacctgaagatgttctagcagcacaaaactataatgctataagaaactggttatatttggatatggcggtttacggtgtatataataatttagtttgggcttacttagaagaacatgatgcctgcccaacatttgcacctggagatgctgaagcattgaaaaatggacatcctgattttattggtttcaactattacaatactgctacttgtgaagctagtgatggaactgaaacaatggatcctggagctgatcagcaaactgctcgtggtgaagccggattctatcgtggatttaaaaatcctaatttaccaactactgaatttggatgggaaattgatccaatgggattccgggcaacaatccgtgaaatgtactcacgttatcgtctgccaatgatcgttactgaaaatggactaggagcatatgataaattaacagaagacggtaaagtacatgatcaatatcgaattgaatatttaagaaaacatcttgaacaggtacaattagcaatcacagacggttgtgaaatgatgggatactgtccatggtcagcagtagacttgatttcaacacatgaaggtatggtcaaacgttatggatttatttatgtagaccgtgaagaatttgatttaaaaactttagatcgttatcgtaaagattcattctattggtacaaaaaagttattgccactaatggtgatgatttaagtgattaaatagatagcttgataagagaaaaagatatttctattttgaaatatcttttttcatttctaaataagaaataacatcttctaatgaatcatagacatgctcaactttttttagatatttttcttgaggaaatttcatatcagggatacagataactgatatttttgcttcagatgcagcttgaatacccgcttcactatcctctaatacaagtgcttcttctggttcaacatttaatttatcacaagcttttaagaaaatatctggagccggctttccatgttctacttcactaccgcatacaataccattgaaatatttcataagattatgttcaccaagtattctttcggccctttctttaccactggaagttgcaacaatcgttttataatagtgaatatttaaatacttcaatagttgaattagtcctttttttaattctacactgttttttagtaagtattgctcttccaatattttaaattgatttatcttttcatccgtatcaaagtctatattatacttatttttgataaagttcattgatgaaataacagattttccaggataatcttctatgtattctttttttgtaaagttaaaaccataactttcaataatatctttgtagcattggaatgagatgatttcggtatcaaccatcaaaccgtccatgtcaaagataattgcttttagcatattaaaccctcctttactttataatataagattacatgataattctatttttataaaggtaaaagatgaaatatgataaaaaatcatattggttttaaatgtttttatcaaataatagaaattattatattatttttctgtttaaattgatatctattattttgtatatttaaaaataagtaataaaaatagtgtagcaattttaaatatatgtaaaaaattacgttttctagtgatatgggcattgtttgatgagtatagatagagaagaaatatacctgaaaattataaactgaaatagggtaccacattaggacttataaatgagttattgaatatctaaagtatagttagtattttttattaagtatcttgatgttacaagaaaaaagcattaatgaaaattaaaaaatagagtctagaacaatgatagtagtctcaaaaatgatgagataaaacttttttaagaccataataaaaaagactcttttatatttattcgtcttgataagtggaattgtggacgagaatgaaaaatagcgctctttttattaaagttgaaggattgtataagcgtgttaaatagtgtttatatttagaaattaaaaagtgtgaattaatcacacttttttaagaacatcttgtctatttacaagcttcctcgatagctacggcaacagcaactgtagctccaaccatagggttgttacccataccgattaatcccatcatttctacgtgagcaggaactgatgaagaaccagcgaattgagcatctgaatgcatacgtcccatagtgtcagtcataccgtaagaagcaggaccagcagccatattatcagggtgtaaagtacgtccagttcctcctccagaagcaactgagaaatattttttaccttgttcaatacattcttttttatatgttccagcaactggatgttggaaacgagtagggttagtagagttaccggtaattgatacatctacaccttctttatgcatgatagcaacaccttctctaacgtcatcagcaccatagcagttaactttagcacgaggaccatcagagtaagctgttgtagataatacttttacttcacctgtaaaataatcgaattgagtttccacgtaagtgaatccgttaattcttgagatgatttttgcagcatcttttcctaaaccgtttaagataactcttaatggtttagttctaactttattagctttttcagcaattttgattgcaccttcagcagcagcgaaagattcatgtccagctaagaaagcaaaacattcagtaccttcatctaataacatagaacctaagttaccatgtcctaaacctactttacggtcatcagcaactgatcctggaatacagaatgattgtaaaccaacaccgattgtttttgcagcgtctacagctttaacatctccatttttgattgccattgcagcaccgacagtgtatgcccaacaagcattttcaaaacagattggttgagttgattttacgatttcgtaaacatcaattcctttttcatcgcagatagctttagcttcttcgattgatttgatatcaaatttagctagtgcagcgttaatttgatcaattcttctttcataactttcaaataatgccattttcgtaccctcctattattcctttcttggatcgatgtacttagcagcatcatcgaatctaccataagttccagtagcttctttcattgcttcattagcatcttttccagctttaaccatatccatcattctacctaagttaacaaattcataaccaataatttcattattagcatctaaagcgattctattaatataaccttcagttaattcaagataacgaggacctttagcttttgttgaataagaagtaccagtcatacttcttaaaccttttcctaagtcttctaatccagctccaacaggtaaaccaccttcagagaatgcagattgagtacgtccataaacgatttgtaagaataattctctcattgcagtattgattgcatcgcaaactaagtcagtatttaaaccttctaataaagtttttcctactaatgcttctgaagccatcgctgcagagtgagtcatccctgaacatccgatagtttcaattaatgcttcttcaatgataccttctttaacgtttaatgttaatttacaagcaccttgttgaggagcacaccaaccgataccatgagttaaaccagagatatctttaatttctttagaatatacccattttccttcttcaggaattggagcacatccatgtgaagcaccttgagcgacactacacatttgttctacttcgtgtgaataaatcattttttctaactcccttcgtgttttcgattataaatagctagtcatgctatttaaggcgaactaaaatcacctgagtaaagtatagaataaagccgagttaaagtcaatgaaacatcaacgattatcaaaataaattcgacaaaataatcggtaaaaaaaggagtttatgaataccttttaatataatattattacactaataaaaacatattgaacaggctatgagtatgaaaatacccatgtttaatcatcgtaaagatatatagggataacactaagatgatttttattgaaatatggggggagaaattaaactactcaaagaacctttgactaaagaaaattatttataatagcaatttttgaagcaattagcattgtcgaaaattcaatcttgaatcatgaattattaatcttattaaaaaggaatggtgttaaattcattaatatccattcaattgggtatgatcatattaatattaaggctaccaaggtattaggaattggtatttcaaataatccttattcagttagttcaattgcggactttatttctttacatattccagtcagcgctaaaacatatcatgctattaataaggataatttttataaaggtgaaaggtagaatcattattattgatacagaatgtgatgaattgattaattcaaagaaattggtagagtgttgcgattaggcaactaatgatatggtagaaaacacaatcttgcttttaaaagagataatgtaggatagaatttcagtgtatgaaattcaacaaaatgtttagaattcattttgagatgatataatattgatatcgaatatgccaaagaattaggaataaaggtttgtaattctagttatggaccggaaggagttgcagattttactgttatgctaatgctgttatcgttacgtcattataaaaaagctttgtggttaggacaggtaaatgattattctttacaagggctagaagggcgagagatgaaagatttaacgataggaattatggggaccggacgaataggtcaagcagttttaaaaaacttatccggctttggagctcgtttattagcttatgatattcatcaaaatgaaaccgctaaaatatatgcaacttatgtcgacctagagcagttttatcaagaatgtgacattatttctttgcatatgccgtatcttaaaagtacgcaccatctaattaacgatcaaacaataagtaaaatgaaagatggaataatcattattaactgtgctcgggggcaattatgcaataccgagtctttaatcaggggaatcgaaaataagaagattggggctttaggacttgatgtggttgaaggtgaagaaggaatttatcatcaagatatgcgtactgatataattaaaaataaaaatatggcatatttacgtcaatttcctaatgttgtcatgacacaacatttagctttttatactgatgcagctgttagcagtatggttcaattatcacttaatggtctatgggcttgttataatgatctggattgggataatgagttaacaaaagatttgtaatcgcagaaatttctgtgatttttttaatgctttttacttgcacataaggttagtatgtgctaaccttattgtagttaggtaaaactaacttcgtgtgaataaatgattctttctaacctggcttagtcacccaggttaaggaatcatgaaggaggaaaacaaatgagtaaaattaaaagtgtatatgcccgtgaggtcttggattcacgtggtaatcctactgtagaggtagaagtaactacagaatgtggagcattcgctagtgcgatagtaccaagtggagcttcaacaggtgttcatgaggcagttgaattacgtgatggtgataaaaaccgttatttaggattaggaacagaaaaagcagtaaaaaatgttaatgagattattgctaaagaattaattggtaaagaagtaacaaatcaaagagaaatcgatgaaacgatgattgctttggacggaacaccaaataaaggtaagttaggtgcaaatgcaatcttaggtgtatctttagctattgctaaatgtgctgcgacgagcttagatttaccattatatcgttacattggaggagctaatgcttatgtattacctacaccaatgatgaatatcattaatggtggagctcatgcagataataatgtagattttcaggaatttatgattatgccggttagcgctccaacatttaaagaagcaatcagaatgggtgcggaagtattccatgctttgaaagccgttttaaaaggaaaaggattaaatacagcagttggtgatgagggaggctttgctccaaatttagcttctaatgaagatgctattaaaactattctagaggcagtagaaaaggctggctataaaccaggtgaagatattaaattggcaatggatgttgcaagcagtgagttttaccaagatggtaaatatgtattaccaggagaaaataataaatcatttacttcaaaagaattagttgatttttatgctgaattatgttctaaatatccaattatctcaattgaagatggtttagatcaagatgattgggaaggttgggattatctaactgagaagttaggggacaaagtacagttagtcggtgatgatttctttgtaactaatactaaacgtcttgaagaaggaattaaacgcggtgtagctaattcaatcttaattaaagtaaatcaaattggtactttaacagaaactttagaagctattgaaatggcccaaaaagcaaattatacagcagttatctctcatagatcaggagaaacagaagatacaactattgctgatattgcggtagcaacaaatgcgggacaaattaaaactggctctgcatcaagaacagaccgaattgctaaatataatcaattaattagaattgaagatcgtctaggtaaacaaagtaaatattctggattatcaggattttaccaattgaataaataatttggataaattttataaaaactattgcatagtcagttagtctgtgctaacatatagacagttagttaaagctaactagagaaaaggagaaatgtatgaaagtagtatttgcatcaagaacaggtaatgttcaaagtattgttgatcgtttaagtgtcgacgccttagaaatatcttctggagatgaggctgttagcgagccgtttctcttaatcacttatactgatggttatggtgatgtccctatggaagttgaatcatttttaaatagtaatggtgaccatttaaaaggtgttatagttagtggtgatcaaggatacggtgaagcattctgtaaagctggtgacgttattgctgaacaatacaatgttccttgtctttacaaagttgagaatgatggaactgatgaagatatagaggaaattaaaaaaataattaataatcaatagttaaatatttgctgatagaggttgctgatatatcatacctacaacgataaaatttcctaatataattattagcactctttaaaagtaaaaaatagtaagaaaggtatccgtgataagctattcacctttttctcgaagacatagacggatacttcttactaaattatcccgtcgaaaacaataatagatttaactattttccaaattccttaaacatagtagtgaatttcctttatatcagttcattctctaaacattcgtccatggtattttgtccttgaaatcatggcatattagaaagtgatagaaaatgtaatttataaaatatccttcaagttataaataatattttcaaatgtaacgaactttaaatccacatccaagtaagtgataaataatttagccattataattatcattctttacattaagttcgtaactttcaaaaccggaagcattccggttttcttttttttattttattggtataattatataaaacgattggaggaagagtagatgatgcacgaatctggtgaaatgtatttggaaacaattttattattaaaaaaacaaaacggtaatgtccgttcaattgatattgctcgagagttgggatttagtaaaccaagtgttagtcgtggtgtaggcattctaaagaatgacggatatattattgttgatagtaaaggatatattgaactaactgaaaaaggaacggaaaaggctactgctgtttatgaaaaacatgaatgtcttacagaatttttaatgcatactgcaaaggtttctaaagaagtagctgaggatgatgcttgtaagattgaacatattataagtgatgaagtatttgaaggaattaaaaagtttttaaacaagtaattgaacgtaagatgcaagaaggcttcttacgttttcttggttttttaagatttttatattttataacagggagaggttgttatgaaaacaaatgaacttgaaaaattattggggactacaaaggataccttacgttattatgaaaaggaggaattaatttcgccatcacgtgatgataatggttatcgtaattatagttatgaagatattcgaataataaaaaatattattatgttgcgctcttttgatctttcaattaaagacatcagacgtatatttaacaatgaaatttctttaaatacatgtttgaatcagaaaaaagaatatttattaaaagagataggtaaaaagcagagaatcattgatttaattgaaaaaaacttatcacgcaagaaagctttttaggttatttaaaaattccagtagacattgaaaataaagtacacgttcttttctcaaatgaagaaataatgattagggagaacataagaaaggattgtcaaatataattatcaggatatcaaaagagtggttttttcgatatgttccagaacttatattccggcgttagctggcgatcatgggtatttgctatttgcaatgtggtcacatattggattattatcacggtatttatatagatttggatatatatgctgaatatagttgtcatttatttgagagtatttctctagataatattcatgaaatctttgctattttaaaagataaggatatcataatcgaagatccgctcaatttgaacggtatttttacccaatatcaaaatttgtctgagcttgaaaaatattttgataataatatgtctaaatagcaaaaaaatatggcttggataacccttgaggtagcgaaatttctcaacagattgataagcttcatacttatataaataatactgaaaaagggagaagaggaaataaattatttatattaaagtctttaataaatagtagttttcctaaacgtacgttagctattttgattttagtttttaattgctccgctatctctttttatcataggagtgattatatttgcctttaaatagataatttcatgatttttaataagtaaaacgggtaattgatttaataaatttaattcattgacaataaaattttattgatttatgcttggattatgagttaccggtggctcttataaaaaggagcgaaaaattatgtatcattcaagatttaaaggagaacattatcagattggatttaagtgggggagaaatttattaaaacataagcaactgtttttaactaatgtaccctttgaaattactttagagcactatgattttgctttacaatgtttaccgatttatcaaaaatttttcccagagattattgaagaaataaggggaattgctgatggacaaaaatgttcatttaaaagtatttgtgctgttttgttgagtatgtactgcattgtttcagaagtacattgttcttgttttgcttttagaaatgaaaatgaaatcttatttggaagaaatagtgattttttaacaaaaattgaaaaactgtatactaattgtatatatcaatttactaatgattcatatgcgtttaatggcaacactacagcgtgcgttgagatggaagatggtatcaacgagtatggtttagcaattggattaactgctgtttatccgactgtaaaacaactggggctaaatgccggaatgatgctgcggctatttttggagaagtgtaaaacagttgatgaagtaattcaattgttgaatacattaccgattgcttcaagtcaaacttttacactggttgatactggtggtgatattgcattgattgagtgcaatagtaaacaaattaaaatcaatagaaataatcagaatgcttttgcaactaactggttcttcagtgaagcaatgcgggaatataataatcatcttattgataattggcaagctcaaaagcgctatcaaactatcaaagaagcgattttaactgataaaatcaacgattttaatgatgcggctgctttattatcaggtaggtatggttatatttgtcagtacgatcgaaaaacaggaaaggatacagtttggtcggtcatatatgatgtgaaaaataaaaggatttttcgagttgaaggaaatccttcacgaaaatcctttatggaagataaaagatttaagttcaagtgattagatgaatgctataactgattgaaaataaacaggtttttattttgatttaaacagaaagataaaaaagtagatgaaaacatgatatgatgattccactaaagtagacacacgaaataaccaaatgggtatctatggaggtgggagcatatcactaagttagccgggttaaaaattttatttgttttgtgtatctacctgacagcccttggattaatttctatcttacttttttatttttgacaattaggacaataatagatactaccacctagatattgttctttttttatttcacagtgacagattgggcaaccacttttataagatttagcgcataagatagttttgtaaccaccagaatttccgtatatatctttttcactgtctcgaccgtggttttcgaccatctttgttagagttctaataatcgcatcatataaattttttatatcttgttcatttaatgtcttaatccttcgtttgggaaagagtttggcattaaacataatatcttgagcaacaccattaccaatccctaaaattctttgcttagttgctaaaaaggctttgatactgagtttttcagtttcatcagtaattaatgttttaaagtaattaagagtaaattcttgatctaaaggaccaatactggttaattctgtttgataatattcattatttgatcctgttatttgatcaaaaagtccaataaaacaatacattgatgttgttacattgatgaaactttgatcagcaaaagtaattagtaatttgcttttttttaatttagttggtttttggtagtagcgaatattagcgccgtcacgaaaggttaaacggtaattctcaattactatttcaacatagtaatttcgcttaataatacctgttacttttttaccaactaataattccttgtatgaattaggatttccttcataaaaagtaaatttatgatcagtgtagttacccccgagatcaattatagtcttaccaagtatttctttttccaagtcatcagcaattgcatatgcttcaggaagttcaatcatctttctcaccagccttatattaatattctaacatagatactgatttaaaaacatcataataaataaaaaagcaaagtgtttagatgatatgattccctcttaaatagattttggttatttgccttggctatttaaagataattatatcaaatatgtctttgctcttaatttaagccttgtcgactttttttaaaatacattaaatcggttgcctgcattccgttttcaattatcttattaggataatagtcaataaagaaattttcaatccgatgactataaacatatcctaaacgtgtataaaaagtgatattttcaagactggaatttgcagtaccaactagaaaagtatcatatgaattgtacgtttcttcaataaatttgattaatgctttggcatagccgtgaccacgatgttcacttaatgtaaggagatttttgatttcaacttcgccatcaattatttctactgcaatgaatgaaactggttcgtcttttaaataaaagccatacagagcgccattttctaggtaatctctaactaaattaatattaggatcactttcagttaaaaggtgatcataatccattttattgtttatttcttttatcattgttttcacttcccaagatgtattataacaaagttttatctaatgtaaaagaatctaattatatgatatactaatggacaaaggagtgcagcaaagatgaagaaaatattaatttgtttgatgatgttacttttagtggttggctgctcatcatcgaatcaaaagaataaaaaagaagaaacagtcaagaaagaagaaaaaacagaagaaaaagagcctgtcaatactagtattaaattaaattttgcaggggattgtacattgggaaattatgcaggacaagcttatgatggatcgtttaatcaagagtatgccaaacagggaaatgatgctacatatttttttaagaatgtcaaaaatgttttcgaaaatgatgaccttacaattgttaatcttgaaggcccattgacaagtgcgacttcacatgtagaaaaacagtttccttttagcggaccaaaagaatatgttaatattttaactagcggtagtgttgagctggtctctattgccaataatcattcagaagattattatgaacaagggatgacggatactaagcaagtacttgatgaaaagggaattggctattttggctatgaaacgtcatgtgtcaaggaaattaaaggaattaaaattggctttttggggtatcgttcaatgtctttatcaatgaataacgaaaaagggcgtgcaacaattaaagcagcaatcaatgacttgaaaaataaccagggagctaatgccgtagtcgttttttatcactggggaattgagcgggaatactatgcgaatagtgatcagcgtgagttagcaaaattttcaatagatagtggtgcggatttagttatgggttcacatccgcatgttgttcaaggaacagaagaatataatggaaaacaaatcgtttattcattaggaaacttttgttttggtggaaatcgcaatcctagtgatacagattcaatgatttactcaattacaatgaatttcactgatggtgtttatactggagatagtcacgaaattattccttgttcagttacctcggttaaaggacgaaataattatcagccaataattttagaaggtaatgaaaaagagagagtactaactaaaatacaaaaatatagttactagaagatgggataaaaccatcttttattataaaataatatatataatatttgtaatctcattatattatctttataattaacatagaaggtgataattatgaagcgcaaattagtatattttctttatagtggttatattgttttcttggttggcttattgggaagccgttttgctaatagtatcagtaaaggtactttaaatattatctgtttatttatttttattggtgttttagctttttgttgtggtggttttgttggttatccaactcgtcaaattgatacagaacagaccatcaaagataagttagaaagccgtgatgatgctattttaatcaaagagttgtttataatgataattccgttagtaattatttttattatcaattatttttgttgagtttaaaatgcgacaatttttttgtaaatgcttgaatcttgaatcaataaatgatattatgcaaatagttatacgactgacggaagtggaattaaccacagggagtataatcatgtaagagccgaccgtctgggcaagagtctggacgagtgtaggctcttttttaattctttggtcaaattgcttgttttgagggcgaaaagagtggttttaaaacaactgtactggttgagaaaaaagccgaaatatgatataaattaggtgtatttttgttttgattattggtgaccttagaatgtttatttaaaaattatatttgaaagggtggcgttatgttaactgatgttgaaattgcacaaagtgcaaagatgaaaccaattagtgagattgctaaaaaggttggtttagaagatgatgatttagaattatatggtaagtataaagccaagattgcacttgaggcgattaatcggctggaaaacaatcctgatggaaaattgatcttggttactgcaattaatcctactccagctggggaaggtaagacgacaacgatgatcggattgtctcaagccttaaataagttaggaaaaaaatcagttgtggcaatgagagaaccatctttagggccatgttttgggatcaaaggtggagctgccggtggaggatatgcacaagtagttccaatggaagatattaatttacattttactggtgatatccatgcaatcactgctgctaataatcttattgcggcaatgcttgataactctattcatcagggaaatcctctaaatatcgatgtacgtaatattgtttggagaagagttgttgatttaaatgatcgcgctttacgtaatactatctgtggtcttggcggaaaagtcaatggaatgcctcgagaagacggttttgatattactgtcgctagtgaagtaatggcaattttatgtttggcaacgagccttgaagatttaaaagaacgagcaggtaaaatgatcgttgcttatgactatgctggaaatccagtcacagtaaatgatattgaagcaactggtgcagttactttattattaaaagacgcaattaaaccaaacttagtacaaacattagatcatacgccggtctttgttcatgggggaccgtttgctaatattgctcatggatgtaactcagtgatggcaactaaattagctattaaattaggtgattatgcaattacagaagcaggatttggtgctgatttaggagcagaaaaattcttagatataaaatgtcgtcaagctaatcttgatcctcaagcagttgtgatcgttgcaactgttagagcgctaaaaatgcatggtggtgttgataaaaaagagttaggcacagaaaatcttgaagctttagcaaaaggaattaaaaatttagaaaaacatattgaaaatattgcgaaatataacctgccttcggtggtagcaatcaatgcttttccaactgatagtgaagcagagttgcaattattaaaagatacatgtaataaaatgggtgttgatgtagctatttctaaagtatgggaaaaaggtgctgatgggggaatcgagcttgctgaaaaactattagaaatcttagatactaaagaagctaattatcaaccattatatgatttaaatttatcaatcaaagaaaaaattgaaactatcgcgaaagaaatctatggtgctgacggagtagcgtttgataaaaaagtattaacaaagatgaaaaagtacgaagcacaaggattagctgatttaccaatttgtgtagctaagacccaatactctttatctgatcaaccgacgctgcttggtcgccctaggggatttacgattaagattaatgatcttatcccatctgctggagcaggatttttagtagctatctctggaagtattatgagaatgccaggattaccaaaacgtccggcagcggttaatatggacattgataaagatggtaagatagtaggcttattctaaaagtgactcattgtcacttttagtggtttaaaaagaaaggaagaaattatgaaagtagcaattattatgggttctacaagcgatttaagtaaggttgaaccagcaattggaattttgaaagactatggtgttgaagtaaatgtaagatgtctttcagctcatcgggcacatttaggattaagtacatttattaaagaaacagaaactgatggaaccgaagtaattattacagcggctggaatggcagcagctttacctggagttgtcgcttctcaaacagtattgccagttatcggggtaccaattagcggggctacattagatggtatggatgcgttactatcaatcgttcaaatgccttcaggaattcctgtggctactgtggcaattaacgggagcaagaacgctgcatatttggcgttacaaatcatggcaatcaaacatgataagattaaagaaaagttattagcatatcgtaaagatatggaaaagcaagcaatgagtgctaatgaagaagttattgcaaaatataaataaaagataagaggagaaatcaaaatggcagaattattatatgaaggaaaagcaaaacaagtttacaaaacagataaagaagatgaatatttgattcattataaagatgacgcaactgctggaaatggtgtaaaacatgatcagtttgaaggtaagggagttttaaacaatacaatttcttgcattatctttgatatgttagaagaagcaggaattaaaactcatatgatcaagaaattaaatgaacgagatattttagtaaaaaaagttgatatcttcccattagaagtaattattagaaatattacaacagggtctttttgtaaaagattaggagctcctgaaggaatcgttttagacgaaccaatttttgaattaagttataaaaatgatgattatggtgatccattgattaatgaagatcacgcagttgccttaaaactatgtacaagagaagaatataattttattaaacaagaaacattaaaaataaatgaattattaaaggaatttttcttaagcttaaatttaaaattagttgattttaaaattgaatttgggaaaacacctgatggtcaaatcttgttagctgatgaaatttctccagattcttgtcgtttatgggatgttgaaactaatcaaaaatacgataaagatgtatttagacaagatattggtgatttaatcgaaacttataaagcagtattagcaagaatgcaaaaataataaaggagattaaaaaatggattacaaaaaggctggagtagatattgaagcaggatacaaatcagttgaattaatgaaaaaacacgttaaggaaacaatgcgtccggaggttttaggtggtcttggtggttttgcaggagcatttgatttaagtgcaatcaaagatatggatgaacctgttcttttatcaggaactgatggatgcggaacaaaagtaaaacttgcttttgtaatggataaacatgatacaattggtattgatgcagttgcaatgtgtgttaatgatattgcctgttcaggtggagaaccattgttcttccttgattatattgcgtgtggaaaaaactatccggaaaaaattgcgacgatcgtaagtggggttgctgaaggctgtaaacaatctggttgtgctttagttggtggtgaaacagcggaacatcctggattaatgcctgaagacgactatgatctagctggttttgcagtcggggtggttgataaaaaagatattattaatggtgaaaacattaaaccaggtgatgttttagtgggaattgcttcaagtggagttcatagtaatggattctcattagttcgaaacgtatttgagatgaataaagaaaccttagatacatattatgatgaacttggaaaaacattaggcgaagccctaattgcaccaactagaatttatgtaaaagcattaaaaaatgttaaagatgctggggtaagaataaaaggctgctctcatataactggtggtggttttgatgaaaatatcccaagaatgttacccgatggagtaaaagcagttattaaaaaagatagctataaagtacccgcaatttttgatctgattgctaaaaaaggtgatattgcagaggaaatgatgtataacacatttaacatgggattaggtatggtcattgcgttagatccagctgatattgaaactagtatggcggcaattaaagcagcaggtgatgaatgttatattattggaagtattgaagcaggtgacaaaggagtgcaattatgctaaaaattgctgtctttgtttctgggggaggaacagacttgcaatcggtcattgatgctgttaaaaataacagcatcaatggtgaaattgcaatcgttatttctaatcgtaagaatgcatatggacttgaacgtgcaagacaggcaggaattgaaactgctgtagtgcgtaaagatgatgaattaattgttaaaatgttaaaagaacgcaatgttggtctagttgttttagcgggatatttagcgatccttacggatgtattgattgatgcttatcctaataaaattattaatattcatccttcattgattccatcattttgtggaccagggcattatggaatgcatgttcatgaaaaagttttagcgcgaggggtaaaagtgactggtgcaacagttcattttgttagtagtgaggttgacggaggaccgattattcttcaagaggcgtgcaatattgatgatttagataatgctgaagatatccaagcacgggtattagaaattgaacatcgcattttacctaaagcagttgctttattttgtgatggtaaaattattgttgaaaatgaaagggctaaggtgatttaaaatgaaaagagcattagttagtgttactaataaagatggtatcgttgatttttgtaaaggcctagtagatttaggttttgaaattgtttccactgggggaacgatggctaaattacaagcagaaaatgtaccatgtattgcaattgatgatgtaaccggatttcctgaaatcttagatggtcgagttaaaactttacatccaaaagttcatggtggattattattccgtcgtgatcttcaagaacacgttgacacagttaaaaaaatggacatccaaccaattgatgtggtttgtgttaatttatatgaatttgaaaaagcgttaaaagctggtaaaccgatggaagatatgattgaaaatatcgatattgggggaccatcgatgattcgttcagcagcaaagaattttaaagatgttttaatcgttaccgatcctgctgattatgataacgtcttaactgcaatcaaagataaaactgatgattttgattttagattaaatcttgcatataaagcattttcaactactggcgcttatgatgcgatgatttctcgttattttgcaggtgttgtaggggatgatttcccagatactttaaacatttccttaaagaaaacggaacatttgcgttatggtgaaaattctcaacaaagagctaacggctatgttgatccatttgtgcaagaaactttattggattatgaacaattacacggtaaagaaatttctttcaacaatgttaatgatttatatggtgctattgccgtagtacgtgaatttaaagatcaaattgttacagctgcgattaaacattcaactccttgtggggtagcgattggcaaagatggttatgattcttatatgaaagcttatgaggctgatcctcaaagtatttttggcggaattgtagcagtaaattataaaatcgataaaaaaacggctgaagaaatgcataagatcttcttagaaatcgtagctgcacctgactttgatgatgatgctttagaagtattgaagaaaaagaaaaatttacgaatcttaaaacttaaaaatctatatgcgcgtgaagctaaatatgatattaaatatttagagggtaaagttttagttcaagatatcaatactgaaatgattaaagaaatgaattgtgtaacaactgccaaacctacagaagctcaacttaaagatatggaatttggtatgcgggtcgttaaatttgtaaagtcaaatgctatttgtatcgttaaagatggtgttacattggctgttggtggtggacaaacatcaagaatctgggctttagaaaatgcgattatcaataataaagataaagattttaaaggtgcagttcttgctagtgatgcctttttcccatttagcgattgtgctgaggtagcatataaagctggaattggagcaatcgtccaaccagggggatcggttcgagatcaagattcaattgatttctgtaatgagaaaggtatcccaatggtatttactggatacagacattttagacattaatagaaaggcctagaatatatgaaagtacttgtaattggtagtggtggtcgtgaacacgccattgcgtataaattgaatcaaagcagtaaggtagataaaatctatgcgattccagggaatccgggaattgctaaaattggtgagtgtattgatggtaaggttgaagataatgaaatgatcgttaattttgctaaagaacatcaaattgatttaactgttataggaccagaggtaccactttgtaatggtctagcaaatgatttagaggcagccgggttaatggcttttgggccaactaaacatgcagctacattggaaggtagtaaagctttttcaaaagactttatgattagacacagtattccaactgctaaatataaagaagttaatagttatgatgaagccgttaaagcaattagcgaatttgattatccgttagttattaaggctgatggtttagcagcaggaaaaggagtcgttattgttgacaaccatgaagatgctactgtaactttaaaagaaatgatgattgacggaagtcttgatggagcaggaagtaaagttgttttagaagaatttttaaccggatttgaatgttcacttctttgttttacagatggagaaacaattgttccaatggtaagtgctaaagatcataaacaaatttttgatgggaataagggtcctaatactggtggtatgggaactgtttcaccaaatccatttatgccagaaggtatggatgaggtaattaaaagagatattcttgatccttttatgcaaggattaaaagatgataatatggactatcgcggtgttgtatttattggtttaatgattgaagatggtaaagcgaaagtattagaatttaatgttcgttttggtgatcctgaaacacaatcaattatgcttcgcttagatagtgatctatatgatatcatggttggttgtgctacaaaaactttaaaagatgttgaagttaaatggaatgatcaacacgttgcttgtttagttctttcaagtggaggatatccaggtaattatcaaaaaggaattgaaatagagaatattgatgactgtgatgactgtgttgttttccatgcggggacagcaatcaaagatggaaaattagttactaatggtggtcgggtcttaaatatttgtgctacaggagtttcattagatgaggttcgtgaaaaagtttatgcggtagcaaaaaagattgattttgaaggcaaatattaccgaagtgatatcggacttagatagggggatgaaaatgagtgatgtaaagcgtatttacgttgaaaaaagaacagcgtatgcaacagaagcaaacgaaattaaacataatttaattgaacaattagggttagaaattgataccttaagaattatcaaccgttatgatgttcaaggagttagtgatggcattttaaaacaaggaatcaacactatcttggctgaaccaatggtcgacgatgtttatcaagaagaatttcctactaataatcaagaagtagtttttgcaatcgaatttttacctggtcaatatgatcaaagagcagattcatgtgaacaatgctttgctattttaacagggaatagtagtgctaaagttaaatgtgcacgggtatttgccattacttttaaaggcgataaagatgaaattttgacgaagattcaaagcttcttgattaatcctgttgatcagcgtcttgctagtttagaaaaaccagctgatttaaatgatgttgctccagaaattaaaccggtgcctacaattaatgggtttaatgaattagataaaaccgatcttgaaaagttcttaactgacaatggtatggctatgaactatgaagatttaaaagtaactcaagattattttaaaaatgaagaaaaaagagatcctactgaagctgaattaaaagtattagatacttattggtctgatcactgccggcatacaacatttgcaacagttattacagatttagatattgaaaatggagcttttaaagagatcttagaaaaggatattgaggattataaaactagtcgtcatttagtttatggtattgatacaaaacgacctttaacattgatggatttagccacaatctcaatgaaagagttacgtaaaactggttatttagatgatttggaagtatctgaagaaattaatgcctgctcagttgagattacggtacatacaactgatggtgatgagcaatggttattaatgtttaaaaatgaaacacataaccatccaactgaaattgagccatttggtggagctgctacttgtttaggtggagcaatccgggatccgttatctggtcgcgcttatgtatatcaaagtatgcggattacaggggctggagatcctcgtaaatcattagcagaaacaatggctggtaagttacctcaacgtaaattgtgtcaagaatctgcccatggtttttcttcttatggtaaccaaattgggttaactacaggttatgttcatgaaatttatgatgacggatatgtagctaaaagaatggaattaggagcagttgttgcagcggcaccaaaagaacaagtaaaacgtctagaacctttaaaagatcatatagttttattgattggtggtcgtactggacgtgatggtattggaggagcgacaggttcttctaaatctcacgatgttaaatcaattgaaacagctggggctgaagttcaaaaaggaaacccggttgaagaaagaaaaattcaacgtttatttagaaataaagaagttagtgaaaaagtggttcgttgtaatgactttggagctggtggtgtttgtgttgccgttggtgaattagctccaggattagtaatcgatttagatgcagtcttgaaaaaatatgaagggttaacaggaacagagttagctatttctgaatcacaagaacgaatggctattgtaattgatgaaaaagatgcggatttcattaaagctgagtgtgctaaagaaaacctagaagtagttcaagttgcagtggttactgatcaaaacagattagtaatgaaacatatgggtgaagatattgttaatatttctcgtgattttcttgatgctgcaggcgctaaacgttatcaaaatgttaagatcactttaccagattttgaaaagacaccttttgataaacagtcacaaactagttttgttgaaactgtgaaagaaactttatcaaaattaagtgttgcttcacaaaaagggttaattgaaagatttgactcttcaattggtaatggaacagtattatcaccatttggtggaattaaatatcatactgaaactgaaggaatggcagcattgattccagtgttaggaaaagagacaacaacagcttcagttatgacttatggttataatccattgatttcaaaatggtcaccatatcacggagcaatgtatgcaattgttgaatcggtagcgaagattgtggctatgggtggaaattatcatacaattagattttcattccaggaatactttgagaaacttctagacaacccaattacttggggaaaaccaacggctgctttattaggggcataccgtgttcaaagtgcgttaaaattagcttcaattggtggaaaagacagtatgtcaggatcttttgaagatttacatgtaccaccaactctagtttcttttgctattacaagtggagatgttaatgatatcatgacacctgaaattaaagaaactggtcatgttttagctgaaattattattaataaagatcaatatcatatatttgattttaatcatcttcaaaaacaatacgatgcgattatggaattaatgaaagataagaaaatctatagtgcttatactgttaaagatggtggtgttattgaagccgttagtaaaatggcttttggtaatggtgttggagtagcttttaataatgaaaatagtcttgaaagctacatagtgcgtgattatggtaatattattattgaggttaaatctgaaaaagatttaagtatctttgataattatcgtattgttggaactactaatgatagtgaattattatcttatggtggtgaaacaatttcattagatgaagcttatgcaattaataaagcgcctctagaaaaagtatatccaacaagagaaaaagcacctactagtaaaatcaaagtggcagcttgtaaaacaagatcagatcttaaaccaaaagtaacagtagaaacacctctagttgttattccagtattcccaggaactaactgcgaatatgattcaaaacgtgcttttgaaaaagcgggagctaaagttcaattagttttaattagaaataagactgaacaaatgcttaaagattcaattgatgaattagaagttgccattaaacaagctaatattgtaatgttaccaggtggttttagtgctggcgatgaacctgaaggttctggtaaatttattgccacagtattgaagaatccacgtttaaaagcagcaattacggatttattagataatcgtgatggtttaatgatcggaatttgtaatggattccaagcattagttaaattaggattattaccatatggtaaaattcaagaaatgtctaaagatgatccaacattaacattcaatacaattggtcgccatgtttctcagatggttgatacgcgtattggaagtgttaaatcaccatggttaaaatatgtcaatgttgatgatattcatacaattccagtaagtcatggagaagggcgttttgtagctcctgaggaagtgattgaagaattgtttgaaaatggacaagtgttctcacaatatgttgatcctaatcgtaaggtaacaatgcaaacaccatacaaccctaatggttcaatgtatgcgattgaaggaattgtttctctagatggacgtgttattggtaagatgggacatagtgagcgtcaaggtgaaaaccgctttaaaaatgtttatggtgaaatggaccaaaaattattcgaagctggtgtagattattttaaaggtggaaaatagaatggaaaaacaagaatttgaatgtctaaccctgtgtccattagatggtcgctattcaggtgttaaagatgctttaggagaatatttctctgaatatgcattagttaaatatagagttttcgttgagattcaatggctaaagttcttaattgaaaatgttgaaagtgacgttttagctaaatttgatttacaagatatggataaacttactactatttcaagtgagtttaattacgactcttttgctcgaattaaagaaattgaaaatacaacacgccatgatgttaaagcagtggagtattttattgatgaaaaagttgatgctttaggatttggatatttacaaagctttgttcacattggttgtacatctgaagatattaataatacttcatatgcttgcatgctaaaatatggattaaaagatgtatggttaccaaaagctaaagaatttgcagctatcattgataaatgggctgaagaacatagtaatgatgctatgttggcgcatactcatggacaacctgcaacaccaacaacaattggtaaagaatttaaagtttatgcttatcgttttttgtctagtattgaaaatgttgaagcagttaaaatcaaagctaagttcaatggtgcaacaggtaactatagtgctattttaacggctttccctaatgaagattggcaagttttagcaaaaaaatttgttgaagagtacttaggtttaacatttaacccattgactactcaaattgaaagtcatgattatacttgtcatattttggatggtattcgtcatttcaataatgtattagtcgattttgatgttgatatgtggctgtatatttcaatggaatactttaaacaaattccagttaaaggtgaagttggaagcagtactatgccacataaagtaaatcctattcgctttgaaaacagtgaagctaatattgatatgtctaataatatctgtattgctttatctaataaacttcctaagtcaagaatgcaaagagacttatcagactcttcaagtcaaagaaatttaggtttagcatttgggtattctttacaagccatcaatgaaacgatgaatgggttggctaagtgtgtagttaataaagacaaactagctagtgacttaaatgaaaaatgggaagtattagcagaaccaattcaaacaatgttaagaaagtatggagtacctgatgcttatgatactttaaaagctttaacaagaggtaaaagtatttctaaagaggatattctaaaatttgctgaaagtctggatatcttatcagatcaagatcgtcaaactttagttgatatgacaccggcttcttatattggtttagctaaagaacttgctaaaatcgaattaaataaatagtagaaaatgactggtttccagtcattttttcattttatgaaataatctacaatctttttataaacaatatatactaagttatataaagatacgtcacattataacgaaagatggaaaggatgtaaatatgaatgtaaaattaatagcagtagatatggatggaacttttttaacaaataataatgaatatgatcaagaacgatttacgaggcaatacgaatttatgaaggaaaagggaattcattttgtagttgctagtgggaatcaatattatcaactaagatctttttttccagatattcataacgagttggctttcattgctgaaaacggagcttatatcgttgatcaaggaaaagatgtttttgttgcaaaacttgcaaaagaggatattcagacagttttaaaggtagttaatcaatatcctgaagtagaaaaaattgtctgtggtcgaaaaagtgcttatattagtaaatacatagatgaagatttttataatacaatgaacttttactatcatcgtcttgctaaagtagataactttgatgattttgatgatactatttttaagatatatctgcattgttcaaaagataattttgaaacgattttaacagaattgaaagagaagatcggacatattatgacaccagttgattgtggacattttggaattgatttgattatccctgggattaataaagcacatggaattaacctgttaatggaacgttggaaaattagtgatgccgaaacaatggcatttggggatagtggtaatgatttagagatgcttgagcaggctacatatggttttgccatggcaaatgcaaaagaagcaattaagaaaattgcggattacacaatttcctctaatgaggaacatggtgtattagaggtagttgactggtatataagtaaaaaaaagatgtttgaataaagaagatgtaaagataaattacttcttctttttgtttgtttatttttcgtaaaaaatccaataatatatatgatttatttaataatatgagatgtatatgttattattttatattagattattgagattaaggagattattatagatgaataaaagagaaataaatcaaaaattaatcgttaattacaaaaatcatctaattgatgaagaaaaaagtttagcaacaataactaaatatatacgggatattgaaaaattttatcaatatgcggataaaaaggaagttactaaggaattagttaaattatataaagaagaattaatgaaatcatataagcctactagcataaatagtatgcttgcagcattaaatcagttttttgaatataatggttggctagaatgtaaaatcaaagaactaaaaattcaaaaaagagtttttttagaagaaagcaaagaactatcaaaagatgaatataaacgattagttaatgctgctcgaaagcaaaaaaacgagcgtctatatgttttactgcaagcaatttgctcaactggaatacgtgttagcgaacatcgatacattacagtccaagcacttaaggatgggtatgcgcaaatatataataaaggaaaagtaagagaaattttttttagtgatgatctaaaaagaatcttattaaaatattgtcataaaaataaaattgaaaatggggcaatatttgtaaccagaagcggaagaccgttagatcgcagtaatatttggaaagcgatgaaagatttgtgtgatgatgctaaggttgagcgcagtaaagtttatcctcataatttacgtcatctttttgcggttacttactataatttaaaaaaagatattgcacgtttagcagatttattaggacattcaagtatggacactactcgtatttatacaatgtcaagtggtcgtgaatttaaaagatattttgatcagatggatctagtattttctaaccgaaaaaataattaaaataaaaatcaaataccacataacacgtattatgtggtatttgattaacaagaactattcttctgaatatcattttacatcattaagttaattttaacaaggaatttgaaatattattaacagcatttttatgggaatctcggacaattattttctttttttctaaaatatatattttttaatatttttaaaaatttattcacacttaaaagaacctcaaatttttaattttttaaggttgtttttgcagtgtttattttttatagtagtttaccacataatacgtgttatgtggtaaataatatatatttaataagatattgaggggtacagaagtggaaaaagaagagttattaggtcaattaagaaatattacaaattgtatgattatttctgatttaaggtatgttggtaaagatgtattgtattctgcaattctgtctttaaatgttgatgattatagtatgaaagaatggcatgatgcaattatatatttaactggaaatgatgtagataaatcaattggtaaagctgctgcaaaagaatacctatgtgactattatcgtcataattaaaaaacattggagtatcttccaatgttttttatagtaaattaatattgtgtttagtacattcatcaatcatttcttgtggccaaatacttgcctgaacttctccaacatgaacttttttcaataataacatacatagtcttgattgcccgattccaccaccaattgtgtatggtaattctttgttaacgatttgactatgataagggagtttaagacgatctaaacaattttcagcttttaattgttttacaagtgtatcttcatcgactctaattcccattgaagaaatttctaatgcacattgtaatggttcaaaccagaataaaatatccccatttaaattccaatcatcatagtcaggagcccgaccatcatgtttaattccactttttaatttacagcctacgcccattacaaaaacacatcctaattctttacaaatcgctgtttctctttcgttaggagttaaatcggggtaacgatcttctaattcttgagatgtaaagaaatgaattttatcaggaaggcggtttacagcatgtggatatttataccatacctcatgttccatatgtttgattactttaaaaatctttttaacatgacgttttaaagtttcttcagtacgttcttctttagcgatcactttttcccaatcccattgatctacgtaataagaatgtaaattatcaacttcttcatcttttctaatggcgttcatatttgtatataaaccttcatgcattttaaaaccgtattttttaagtgccattcttttccatttagctagtgaatgaactacttcaatttgttctccaggtatttcattaatagtaaatgagacaggtgattcgaaaccatttaagttatcatttaaaccactacttttttgaacgaatagcggagcagatattcttgataaatgtagagcgcgtccaatctctttttggaaagtatcacgaatatatttaattgcttcctgggtttgacgaagatccaaaactggatcgtagttttcaggtataattaagttcattgtaattattaatctccttttaattattttctacattgtaacatgtataaatacatgtatacaactataaaatcgagtaatttttataaacgtttattgtaaaaagtaaaaaaagacgataagattataattacaatagaaggaggcataaaaatggcacttgatgaaataaaatatcagacatatgtacaaatcttaaaagaggaattagtaccggcgatggggtgtacagagccaattgctctttcttattgtgctagtaaggcccgtgatattttaggaactactccaacacgctgtctagttgaaataagtggtaatattataaaaaatgttaagagtgtaattgtacctaatacaaacggattaaaagggattgaagcagcagtagcagcagggataattgctggcaatgcgaacaaggtattggaagtaattgctgatgtaaaaaaagatcaaatcaaggaaataaaagattatttagagcataattgtattatagtaagaccattagaaacggagcatatcttagatattaaaattactttatttgatgatgataattatgccatggtcagaattgttgatcaacacactaatattatatcaattgaaaaaaatcatagagttttattctctaaagaaaataaaatttgtaataatgaaatggtaattgatcgttgtagcctaaacgttaaggatattttggaatttgccaatattgttgatctaaatgatgtcaaagagattatttcaagacaaattgcttataatagtgccattgcaaaagaaggattaactaataattatggcgccaatattggtagtgttttattaaattcaggacaggatattattactcgtgcaaaggcatttgccgctgcaggaagtgatgcacgaatgtcagggtgtgaattgccagttgttattaactctggaagcggcaatcaaggaatgaccgtttctttaccaatcattgaatatgcaaaagagctaaatgttaatgatgagaagttataccgtgctttagtactaggaaatttgattgcgattcatcaaaaaaatggaattggtcgtttatctgcttattgtggggctgttagtgccggatgtgcagctggatgtggaattgcttatttatatggtgctgattatgaatgcattgctcacacaattgtaaattcactagcaataacttcaggaattatttgtgatggtgcaaaatcttcttgtgcggcaaaaattgcagctagtgtggatgctggtattcttggatataagatgtatttagatggtcaagaattcaaagacggtgatggaatcgttgttaaaggtgtagagaatacgattcgtaatgttgctcgtcttggtaaagaaggaatgaaagaaacagataaagaaataattaagatcatgacaaactgctaactttttattttattagtatgctatgaagtgtttattattttatagaatgagttaaaattataatcatgtggtataaaatgaaaatattggagaaatagtatatttatgatgacagagaaaaatcatctcaaaacaactgactgattaattgaggattagtgataaaataatttcaaaatgggaatgtggagtttcctaaacaaaaggatattaaggaataacctgtatttacctgcttgcaaatgaatataggtataagagaaatgttgtaaatgtatttctattattctataatgaaacaaaaagcaggtggggaaatggatattagagttttaaattattttttaatggttgcaagagaagaaaatataacaagagcttcacaacttcttcatatcacacagcctacgctttcaaggcagcttatgcagctagaggaagaattgggtgtcaaattgtttcaaaggagtaatcatagtatatacttaacaaatgacggcttattatttcgccgtagagcacaggaaatcgtgaatttggcagataaggcacaggcggaattaaaacaagatactgatgtattatcaggaaacattgcaattggctgtggagaaatgagaagtgcacaagaaatcgcaaaacttatcactgattttcaaaacatataccctttcgtacaatttgagttatatagcggaaacaacgaaaatattaaggaacgtatggaacaaggtactttagacttgggcttgttattagaaccagtgaatgtcgtaaagtatgattttatccgtatgaggacaaaagaacaatggggcgttctcattcataaagataatcccctttctaagaaacaggtaatctaccctggtgaattagtaggcacaaaggttataacaatacaccttgatacgccagttcatcatgagttggcaagttggtcaggggattttgcgaaagaaatggaatcatgtgcaaattataatctattgtataatgctgtaattgttgccaaagagaaaaaaggagcagttatctgtgtgaagttagataattattatgatgacatgaagtttattccttttgaacctaaacttgaattaacttctgtacttgcatggaaagaccgtcaatcatattctaaggcaacaaatacctttatcagttttataaaagaccgctataaacataattaaaatagaaattcaatatttgtatttctgttaatccaacataagcattagacatatcaatgaatgaactttaaaatataggtgtaacaagataacccgctatcttggtgcacctattttctttgaaaggggtggaaaattgaacctttacatgaggggtgaaaaatacaatacaatccttaatgatttggggttcacaaatgcaaaaattgaattatatattagactttcacatttaggcacttcaacaaaagaaaaacgaatacagatagtaagcgaaaaacgtagaaaaattcttgaagaaattcatgtaaaagaaaatcaattacaggaaatagattttttacggcatgaattacagaatgcgtaaatgaaaaggagttgaaaaaaatggagtttatcactttaagcaatggcgtaaaaatgcctgcacttggatatggaacattcacaatgagcaatgaggaaacagagcgttgcgttttggaagcaattaaaactggatatagactgattgatacagcacaagcatattacaatgaagaaggtgttggtaatgcaatcataaaatgtggtgtacctagagaagaattatttattacaacaaagatttggattgaaaatgctggatatgaaaaggcaaaggcttcgcttcatgagtctttgaaaaaattacagatagaatacattgatttagttcttattcatcaggcgttcaatgactattacggaacatggaaagccttagaggaagcatataaattaggaaaagtaagggcaataggagtgtctaatttttacctcgacagatttatggatttagcaactttcagtgaaattaagcctatggtaaatcaattagaaactcatgttttccaacagcataaaaatgataaaaagtttttagagagatatggaacaaaattggaagcatgggcaccatttgccagaggtagtcaaggtatttttgagaatgaagttttaatgaaaattgcaaaacagcataataaaacaatcgggcaagtagcattacgttttctaattcagaatggaataatcgctattcctaagtcgactcataaaaatagaatggaagaaaactttaatatatttgatttttcactatcagatgaagaaatgaaaaaaattgaagaattggacttgggtgaaaatgtatttatgaaccacgaaaatgcagaggatattgataaatttttcaaaatgtttcatgtcgggcagaaataaaaaggagagatgaaaaatgataagacatatttttattgcaacaatcaaagagggagtaactgacagtgaaatccaaaaagaaatggaattgatgagaagcatgaaaaatgaacttccggaaatcaaagaaattatcgtagaaaaaagtaaagggtggattggtctaagtgatgttgttactatgacgattgatgtagaaagtaaacaagattttgacaaagttattcaaagtgttgctcatcaaaaggtaagtgcaacagcaccagactttttcagaacagataattttatattaacacaaatagaatatgaaaaggagtagtgtaaaaatgagtaaatctttagtagcgtattttagtgcaagtggtgtaaccaaaaaagtagcagaaagattaaatgaagttgtgcaggggaatttgtttgaaatcgtaccagaacaaccttacacaagtgctgatttgaattggacaaatcctaaaagccgttcatcagtagaaatgaacgataaatcgttcagaccagccgttaaagaaaaaataagtgatatgggagaatatgacataatctatttaggatttcctatctggtggtatattgctcctacaatcatcaatacttttcttgaacaatacgatttaagggataaaacaattattccatttgcgacatctggaatgagcggaatgggaaaaacaaacgattatttagaaaattcatgcaagggtgctcgtttgatgaaagggcaaagatttgacgaaaatgttagtgcagatgaattatctgactgggttaaaaaaatgaaataaaaggagtaatgacttatgcaaaatatattagtagtatctggacacacagacttaaataattctgttgcaaataaggcaatattagaaaggcttgaaaataaattaccacaggctgaatttgtctatttagacaaactttattcagattttcaaattgatgttgaagcagagcaagaaaaacttttaaatgcagatataattgttttgcaatttcctattttctggtatgctatgccttcattactaagtcgctggcttgaagaaacatttcagcatggcttttcccacggttcaaccggtgataaattgaaaggaaagaaattgattgcttcttttacgactggtgctccagaatttatgtatagttatgaaggggcacagaaatatcctattgaagatttcctcccgccgataaaggcaatgtgtaatttgtgtggattggattactttggatatgtctatacaggcggagtatcttatcaaaatagaaatgatattgaaaaaatggctgaaatgaaagaaaaagcagttatgcatgctgataaattattggaattgttagaaacactgtaacaaaaaaagatcatatttttgaaaattggaaattaatcagaaaataaaagctaaatattctgattagttttatatataagtaattttgtcataaatataaactctaccgatggttgattgaataattagaattttaatagtagtataggctcaaggagtgaaagatatgagcaatatagataatgaaaaatgcggatccttcatgatggagttatgaaaagagaaaggtttgacacaaaaagaatttggagaaaaattatgtgtatcagacaagataatcagcaaatgggagctatcacgatatccaatacttgcaaaagctttagaattgagttataaggagttattagatggttgaatttggtttcaacacaagaaaagaaaaatattacttatgatagttgtcaatggctggcaattctacattttaattatcgagatctggtaattttaaaagtacatgtataaatttgtgaaaataaaacatatatattatttaatcaaagcacaaattatcttcaatatacaacgatgatatgtattattatgattttttgattgaaatggggttagaaatctttgctgctaatttggataattataattttgattatgatttagaggttaagagtgataatctattaaaagtggctaaagaatcacaataacaatactaaaaaagttttagtatatactgatttttatttttgagaaaatgcacatattgataatgattgaataaataataaaaaatagtattatttttttagcggtgcaacaaacaaaacgccccgaacccgcataaatgcttgattttccggtatatacaaccgcggtttcaaatgctcaaaaaaacactttgacgcttttttgccgctctaactcaataaggcaatatgaaacgatacgggcagatataagaaaaatcatactgttcgagagcgaaagcacttgttgcttttgctctcttggatgccacgcaagcaagggcggctggttttgctatttgttttctgaaaggcattgacaggagtatgaaatcatactataatattgagtatgatttcatacttaaaggagagcaaatatgaagtttgaaaaacatcccgttctacaagaatttgaccgtttgaataatgcgattgatgagctttatcacgatatttgcctaatgcaaggactttccgatagtgcttatgcgattttgcaggcaattcttgtgttaggaaacggctgtacgcagacagaaatttacaagtacacactcttgaataagcaaaccgtcaattcatcggcaaaaaaactaaatcaagacggagtgattgaatttcaagcaggtgtcggacgagaattaaaaatctatttgacagcaaaaggcgaggcacttgtaagggaaaaaatattgcctattgaacaagcggaaaacaaagtctttgaggaaatgacagaaaaggaacatcaagagatattgcgtttggtggaaaaatatctaacatctttccgcagtaaaattgaaaatctataagaggaataatgatgatacacaaattaatcagtacaatcgggttgggcattttaggtgttgacccatttacagcagtttaccttttgtctatgggactgcggcaagaaaagaagtcgaatattacgctgttcttcctctcctatgcgggatttagcgtttttatcggcgctatactttccgctattttcggtgctacggcagtagatattcttaaaagtatagtgcctggggacaatagcccgttttgggcagttctggagtttatggtatccgtttttattctgatatgggtgctacgaagatttttggatattagcaaaaaaaatgagaaaaaggagaagaaaactgttaatggggcttggattaagtacctaagtaccggctttgtatttgcaatctcttgttttactgaccccacttattatgccgttattcttatgggcggtgaagtgggaaactttctgaccgcaactctgctcatgacgatttggtttgtagtcagtcagtttatggcactaattgtctatgtcgccaacagcctaaatctattggacaagttggttgcattggttgataaactgaaagcgaaaaatataaagcctatcacctataccatctatgccgtattattaatcattgctatcgtattgctgattgatacaggattttatttatttgacggcagatacctgttttaattaatttttagtgttttcaatgtccttgtccgtgatatgaaacagagaaaagttgttgcggttttccccttaaaattgccaaagacctcatactgatttgttataaaggtagaaaataaggcaaatgaggttaacttatcaacgacaaaaaatgcttgcatttcacggaaagggtacccctttcctatgcttgctacggaacttttcataaaggaatggaaaggaaaaggataatcagaacagatagcagcttgctttggaatgttacgcagtcaaatgatatttttcagggaaaagatataaacaccttaccctatcagttttcgtgtctgcaatgccgttcgtgcaaggcttaatgagcctctaatgcgtaacatagagagtaggaaaaaatcatcttctgcatttgatttttgcttttgtatttgacgcttttttgacgcccgcgcttacaaaacgaagctgtgcggagatatgacagaatatatagagatatgggaaaaccattgaaaacacagggattttcggtaggtctataaacacttgcaagaagttataagacgatttccgtctataaaatcaataaaaaaatatctaattttagttggtcaaaatattgattatgaaaaaattgttatatagaataaaaatggaactttaaaaattgctctaactggtgaaacagctatattagcaaacaagtgcattcacgtttttgaaatcgagtatacttgtaataaatttatgctaaaggtcaatggtgaatttaaatatatttatgaagttgaaatcgatagataaagtgtttgagtaatttatgcttaaacacttttttgttgagaagatgagataaaccttgtataattaagaaaataattacagggggaagttagaatgcgagatttaagcaatattaaaaatctaattattaaaataggttcatcatcattatgtgatgatgaagggaatattaataaagagaaaattttaaatttaattcaacaaatagcatatattaagcgtaaagggataagtattacattagtcagcagtggtgctattaatgctggagttcatgtaatgaatcttgaatgtcgcccgcaaactattcctcaaaagcaagctctggcagctattggacaggcttcattaatgcaaatatatgaagatttatttagcttatttaatttaaaatgtgcacaaattttattaaatcatgatgattttgatgatcgtaagcggttgatgaattttaacaatgcaatgcaggcattgattgaatatgacgtagttccaattattaatgaaaatgatactttagcggtcgaagaaattaaagttggtgataatgatacattagcatcactggtagtaccggctgttaatgcagatatggttgtactagtcagtgatattgatggattatatgatgataatccacatacgaataagaatgcaagattgattcgtaatgtcgatgggattactaaagaaattgaaagcatggcaaaagatgcttcaagcaaggttggaactggaggaatgattactaagattagagcagctaaagtttgtaatgactttggctgtgatatggctattgttaatggtaaccaaccaaacgttttgattgatctgattgaaggaaaagatgtgggtacttattttgatggtaaacctggaagactccttaattctagacaacattggattatgtatcgaagtatgccaaaaggaacaatcgttgttgatgaaggtgctaaaaaagcattagttacatgccactcaagtttgttgcctaagggaattattgaggtaagaggaaattttttaatttcgcagattattgatattgttgatggtaatgatagtctgttagcacgtggaatggtaaattactcaagtgatgagataagattgattaaaggattgaacactagtgaaatcgaggatgttttacattataaagattatgatgaagtagttcacgcaaataacctggtattagtagaaggagtgaaaaattaatgatagaagaacaattaaaacaggctaaactagcttgtcgaaagatgcaaaatattgataaagataccaaaataaaagctttagaagctattagtaaaaatttgatttctaatattgattatatcgtggccgaaaataagaaggatgttgcttgcgccaaggaaaacggaatcagtgaggcaatggttgatcgacttttattaactaggtcacgtattgaaagtattgctaatgatgttttaaaagtagctggattacatgattgcattggtgaagttgttcgtgagataaaacgtccaaatggcttaatcattaaacaagttcgtattcccattggaacagtagctactatttatgaatctcgccctaatgttacagttgacatagctgctatttgtataaagacaaataatgtttgtattctaaaaggcggaaaagaagcgattaattctaatattgctctagtaagggtaatcaaagaggcaatcacaaatattttacctgaaaatgttgttaatttgattgagaaaacagatcgtagtgttgttactgaagttatcacagccaataattatatagatgttgtcgttcctcggggaggagcagggttgattcaacatgttgtaaataatgcaactgtcccagtaattgaaactggtgcaggaatttgtcatctatacattgatcaagaagctgatttagaaatggctgttgaagttgcagttaatgctaaaatttctcgtccttcagtttgtaatgcgattgaaactattttagttcatcaaggtgttgcaaatgaatttttaacgttattaaaaccaaggtttgataaaattaagatatttggtgatgaaatagttttaaaatatctagaaggcaataaggcaacaaccaagaattatgctactgaatatgatgattatatttgtaatattaaagttgtgaatgatatcaatgaagcgattgagcatatctatgattattcaaccaaacattctgaaagtattattactgataatgaagatacagctagatattttatggattctttagattctgcctgtgtttatcataatgcttcaactcgttttactgatggtggagaatttggatttggcgctgaagttggaattagtactcaaaaattacatgcacgtggcccaattggactgcaggaaatgacatcaacaaaatataaaatatttgggaatgggcaaataagatagatataggcaaattaactgtctatatcttttttatttttagttgaatcagattagaattttgaaagttagataaatattttgattgtattaaaattactaatttatccaataataaattagtaaataattgaggtaaataaatgaataaacagtttaaattaataattaagatattattgatgataatatcaggtcgttattattatagcatcttaactaatgagtattgttataaatttgttgatcaaaaaaagattcaaaatttaaagactaataccttggggataggaacatataatataaaatccttaaattatgggaaaaatgatttaaaaagttttaataaggatattattgatttaaaacttgatattatttgtttgcaagaggtagataagaattctttacgttcaggcaattttgacatgctaaaaatcatggcaaattctagtggatattgttattattatttttatcctaccatgtggattttaagtggttactatggtttgggaatcttaagtaaatattctataatagaagttatggctcaacgattaccaaatagcataataagggaaccgcgtatccttacaagaacaaagctctattttaatgagcagataattaatatttataatacccatttaacttatgcggataatcaatatcgtattaaacaaatggattatgtaaaaaagcatgttgattttaacagttacagcatcttagctggtgattttaattcatttaaaatgaacaataaatttaaaatggaaggggtaaagtgtatcaacgagaataaaaaatacaagactttctgcgaatttgcagcacctgataatattttttatgcagatttttttgaattaaagaattgtggtttgaaaaaatcatcattttctgatcatgatttattgtatggtgagttttttctaaagggttagattcaagacgaatacataattgttaatgtcttgacatcgattataattatcactaaactataattaaattatataaaagtgaggctaaattatgaatattgatgaaagagtgaaaaaagcatatgctttacatcattcaggttataactgcgctcaggcagtacttggggcatatgtggatttatttgatttagatatggatagggcaatgactattgcttatggttttggtggcggtgtcgggatgacaagagaaatttgcggaactttaactggtggggctatggctttaggacttaaatatggtaaaggtgaagcagatgttaaacaaaaaaaatttgttaatgaaaaagtagcagctttgtgtaaagaatttgaagattctcatggatcagtggtttgtggagaactactaggattacgggaaacaaataaaaaagttaatcgtgctacttgtgatgatttaattgctgaagtagtaagattactagaaaaatatttagttgattaagatgtcaaatttgacatctttttaagtatgacgacttgtcatacatttagggtgaaagtccttcgtgaacgtagttgtcgacgaatcgcatagtgcatcggaaatgtatttgagccaaaggacatatacactaggatctaggcattagaaagtgaaaaggagaagagcatgcaaattatgtctaaattattagaggaagtcttatctaagaaaaatatgatacttgtctataaaagtacaagtcgtgtggataatgtatgtagccaatgatgaaataaaagattatgttaattaaaactagaaagacatcaaaagacaaatcgaaacaaggttttacaaaccacaacctgttaaaagggttgaaataccaaagcctagtcatggtgttagaaaacttgggtcaatcatggtagagcaagacaaatatcatacgctattaattcgtgataactaaaacatgtgttgtgcgtgctgtagcaaaagaaaggctagcacataaagactagttagttgtttggattattatttattgagatataaattgaaatttaattaaactgccgtatatggaaccgtatggacagtggtgtaagagaggaaaattatttaaaatttttcgctacttgattataaaatagttgacaatggttagtagactaactataatagttagtgtactaacggaatagttagtcatctaactaatgaaaggaggtacatcatggaagagataagttttgatgatgttgaagaagtaattaataattttcaagggttaaataaaacaatgcattatatgatgatggaaaaaacagaaaagtttgatatatcaccggatcaaacaaggttattatttatgttgcagaatcatcaaaacattaatcaaaatgctttagcaaagaagttaaatattactaaagcgactttatcagtgagattgcagcgccttgaaaaactgggttatttaactagaacacaagataaaaatgataaacgtaattatattttaaatattacaaaaactggagaggtatttattgaggcggcaatcaaaattatgaaagaaaaaacaatgattatgtttgaaggggtttctaaggaacagataactgttattaatgatgttattaatatcatgaaaaagaatattgaaaaatgtaaaggagaagaataatgctaaaattaaaacattattttaaaaagttttgggcaccaattctactttgtgtaggattattattcttacaatcacaatcagaattagcattacctgattatatgtcggatatcgtttcggtaggaattcaggctggtggctttgatagtgcagtaagtgatgttttgagtgaagaaacatataatcatttattagtactgatggatgaagaggatcagcaacaatttatggatgcatataaattagttgaacccagtaatcttgataaagatactttagataagtttcctaaagcaaaaggtcaaaatatctataaattaaaagatctaagtgaaaaaaaattagaccgtttagagagtattttagttaaaccaatgttgatggtaacatcaattgatggaatggataaaaatagtaaagaatatcaagaacagtttgggcaattaccgccaaatatgacaccttacgatgctttagcaatgatggataatacaactaaagctaaaatgtttagtaaaattgatagtcagatggaaacgatgggtgaatcaactttaaaaattgctgccggtaacggtgtaaaagcagaatattctagactaggttgtgatactgataagattcaaaatgactatattttatggtctgggttaaaaatgttagcaattgcattagctggtactgtatgtgctgttgcttgtgggttcttggctagtaaggttggggctggtgtttcgagattattacgtcgtgatgtttttgagaaagttgaaagtttttcaaatgaagaattcaataagttttcaactgcatcactgattacaagaacaacgaatgatattacccaagtacaaatggtcgtaattatgttcattcgaatagtatgttttgctccaatgatgggaattggggccttgatcaaagcttttaataatacaccatcaatgacttggattattggtttagttttattggtgattttttgtttgattggtgttacttttgcaattgtgatgccaaagtttaagatcgtacaatcattaattgaccgtttaaatttaacaatgcgggaaaatctttcaggtatgctagtaattagggcatttggtaatgaaaagcatagtgaagaaagatttgaaaaggctaatggtgatctaacaaatgtcaatttgtttgtcaatcgaacaatggcttcattaatgccgattatgatgttcatttttaatgtagtaacattattgattgtatattatggagcaaaacaaattgatttaggtaatattgcaatcggacaaatgatggcttttatgcagtatgcaatgcaaattattatgtcatttttgatgattgcaatgatttcaattatgttgccacgggctagtgtagcagcagatcgtatttatgaagttatttcaatggaacctaaaattgttgatcctaaggaacctaaagcttttattgaaagtaaaaaaggtttagttgaattcaataatgttacatttaaatatcctggtgctaatgaagcagtattagaaaatattagttttactgcaaagcctggtgaaactacagcatttatcggttcaacgggatccggtaaaagtacgttaatcaatttaattcctcgcttttatgaagtaactgaaggtaatattaagattgatggtgttgatattcgtgatgttaatcaacatgatttaagagataaaattggtttagtacctcaaaaaggattattattctcaggaaccattagatcaaatttaacttatggtgcacctgaggctacagacgatgaacttgaagaagtaattcgggtagctcaggcaaaagaatttattgataataaagaagaaagattagatagtgaaatttcacaaggtggaacaaatgtatctggcggtcaaaaacaacgtttagcaattgctcgagctattgctaaaaatccagaaatctttatttttgatgatagtttttcagctctagatttcaagacagatgctaaattacgtcaagaattagataagatggttaagaagactaaaaatacagtattgattgtcggacaacgtattgcttcaattatgggagctgaacaaatcattgttttagatgaaggtaagattgttggaaaaggaacccatgaagagttaatgaaaaattgcgatgtctatcaagaaatcgcatattcacaattatcaaaggaggaattaggacatgagtaatcaaccaaaaagaaatggtcctaaattcggacctggtggtatgcacggaatgcgtggcggtgaaaaagctaaagattttaaaggtactttaggtaaattatttaaatatttaagaccgtattattttcgtttagttatagttgtgatttttgcttcagcatcaacggtttttgcaatcgtaggaccaaagattttagctaaagcaacagataaattaagtgaaggtatcatggctaaagtagctggtactggtggaattgattttgattatattggtcaaattattttgattttagttggattgtatttgattagtgctttatttagttatatacaaggttttattacttcaactatttcacaacgagttgcttatgatttaagaacatcaatttctcaaaagatggatcggatgccattaagttattttgataaacatactagtggtgatattttaagccgagtaacaaatgatatcgatacaatcgcacaatcactaaatcaaagtatgtcacaggtaattacgtcgacagtaacggtaattggaatctttatcatgatgttgactatttcaccagttatgactttgatcgcagtttgcgtattaccagtatcaatggttttgattggtttagtaatgaaacgttcacaaaaatattttgcgcgtcaacaagctgctttaggtgatgtcaatggtcatattgaagaaatgtatggtggtcataatgtggttaaagcatttaatggtgaagctgcctcagtagaacaatttaatgagtataatgataatttatatgaaagtgcttggaagtcacaattcttttcaggtttgatgcagccaatcacaggatttgttggaaatgttggatacgttgcggtatgtttattaggtggtgttcttgctggtggtggtagtatcacaattggtgatattcaggcctttattcaatatgtaagacaatttaatcaaccaataacacaattagcacagacaatgaatatgttacaaagtacagcagcagcggctgaacgtgtttttgaatttttaggtgaagaagaattagaaccagaaacaccaaaagttactgctgatgaggtggctaaagttgaaggttctgttacctttgctgatgttaattttgggtatttaaaagatcaaacgattattaatgattttagtttacatgttcatgcggggcaaactgttgcaattgtaggaccgactggtgctggaaaaacaacgatcgtaaaattattaatgcgattctatgaattaaatagtggttcgattcttattgatggtaaagatattcgtgattttggacgtcaggatttacgatcattatttggaatggttttacaagatacttggttgtttaatggaacaattaaggaaaacctaatgtatggaaaattagatgcaagtgatgaagaagtcaaggaggcttgtaaagtcgcttatgttgatcattttgtacaaacattagagaatggatatgaaacaatgatcaatgaggaatcatctaacatttctcaagggcaaaaacaacttttaacaattgcacgtgctttcttaaaagatccaaaaattttgattcttgatgaagcaacttcttcagtagatacaagaacagaagtattaattcaaaaaggaatggaaaagctaatggagggaagaacaagttttgtcattgcccatcgtttatcaacaattcgtgatgctgacacaattattgtaatgaaagatggtgacattgtagaacttggaaatcatgattcattattggctaaagatggcttctatgcctcattgtatcgttctcaattcgagggatcagatgaatagaaacagtttaaacaactgtttctttttttgcttttaaagcgggaattagttataattataaggaaatggaagtgatgatgatgaagcagcaagcaatgtttaaaaacatgtcaaatgaaccactggcaaatcgcctaagaccaacaactttgactgaatatgtaggacagaggcacttaattggaccgggaaagattttgtaccagctaatcaatagtgatgttgttccctcaatggttttttggggaccaccgggagttgggaaaacaactttagcacgcattattgcaaatcaaacaaaagctaagtttattaattttagtgcggtgactagcggcattaaagatatacgggcagttatgaaacaagcacaggaagttcaggatctaggcgaaaaaacaatcgtctttgtagatgaaattcatcgctttaataaagctcaacaagatgcttttttaccatatgttgaacaggggagtattatattaattggggctactactgaaaatccttcatttgagattaattctgccttattatcaagatgtaaagtttttgttttaaaagcactaacaaccgatgatttatttggtttattgcattatgcgctgataagtccgaaagggtttaaagatcaaaatgttatgattgatgatgatttattatacatgattgctggtttttctaacggtgacgctcgagttgctttaaatactttagagatggcagtcttaaatggagcaattactcatgatcgaatcgtagtggataaagaaacgattgaacaatgtatcaatcaaaaatctttattatatgataaaaaaggtgaagaacattataatattattagtgctttgcataaatcaatgcgtaatagtgatattgatgcttcaatttattggatgtcacgaatgattgaagctggtgaagatcctctatatgtagcaaggaggctgattcgatttgcttcagaggatattggaatggctgatagtcgtgctttggaaattgcagtagcaacatatcaagcatgccattataatggcatgccagaatgtaatgttaatttagctcattgtgtaacttatatggccttggcacctaaatctaatgcgttatataaagcatatgaacgagcaaaacatgacgctttgaatacaattgctgatcccgttcctttacaaattcgcaatgcgccaactaaattaatgaaagaattaaattatggtaaaggttatcagtatgcgcatgattatgatgataaaattacaaatatgcagtgtttaccagataatattaaggatcatcgttattattttcctactaatcaaggaacagaggcaaaggtgattaaacggatggaacaaattgaatatttacgaaagtatcataaggattagggattaaatatgaaggatgaattaggattaggatattgtggtcttgtttgtgggctgtgtagtgaaaatgaaagctgtgttggttgtaaaaaaggtgggtgtccagaaaaggatttttgtaaaaattatcagtgctgcacaaagtcaggatatgatagttgttgccaatgtcctgattttccttgtcaggatagtattttacacaagttacggattagaacattttgtaaatttattggacaatatggggaagaaaaattaattgcttgtttaaggaaaaatgagtctaatggagtaatttaccattatcctaacagccatttaggagattatgatttagagagtgaagaagcaatttatcacttgattttaaaagggaaataaaatactacttgtgataatggtgatattttattataatgatgaggtatttaaaggagaagtttcaatgataaaaaacataattggcggaatcgctgttggtattgctaacgttattccaggcgttagtggtggaaccatgatggtaattctaggtatctttaatcgcatgatggatgctattagtggaatctttaaaaaagaaaatcctaatcgcaaagaagatattatctttatttttcaggttttggttggcgctggagttggaataattggatttgcgaaaatattggaagtgttatttgaatattatccaacgcagacgatttattggtttattggtttgattgcttttagtattcctttatttttaaaaggggaaatgaaaggtgaaaaacttgtaattatcccttttatttgtggtttagcaattatctttgggttagaatttttaaatcctggagaagggaaagtagttgttaatcctgattttcctgctctaagtgctggtttgtttgttaaaatgataattattggtgccgtatcaggagcaactatgattatgcccggtgttagcggtagtatggttttattaattttaggagaatattatctatttaagtcttatctagcaaatgttactagttttagtctggatgttattatgccgctaggatttatggcaattggtattgctgtaggaatagttgttagtgcaaaattatgttcatatttcactaaaactcataaagctggattcttgagtttgattttaggattgatcgttgcttcatcattagtattgattccttttgatgtaagttataatttaagtttagttgtgacatcaattattgcagttattttaggaggaatcattgttcttggattatctaagattcaatagttaaaatataaaaaagaagttattgattgtaaaaccaatgacttctttttctgtgtgtcgagcatggcatacatctagctggtgaaaatccaaccacgggtatttaccgccaagagtagtgaaccacaagccgttagtagtgatgctatgggcggaggaagtggtgtggaaaaatcttcgaggttacgaaaagaaatttgatgaggctgaatggtggacaaggttgcagaacaaaccaagtccaaaaggtaaacgtaaaaccaagacagtaaatcaaaaacctgtgaagataaaaaggatgtatgccttacctcgggaggccttgtggacgatgaagtccagtaaactttaaaaacagtaatgataccatcgatagaaaaagatttatcacaagaaatcagatgaagtcatagcagtcagaaatgatgaaggactgaaacgtttatagagtgtaaatcgctataagtaatatttggatagtccgaaagtgaggatagcaactattattgataaggggttattagaattcaaaagtactattatcaaagattttattttagcattttgtgatagtcagtttattgccaaatacgattatttagagatgctaagtcagctgatagaaattttttattactattgaagtgaagttgacgagggagtgagtgatatgtatattgaattcgatttaggaataattcagctaataattaacttttattgcttgtttagtcatttttgttagtttattttggtattcaactagacctttggtcttaggtgctagaaggaaaatatgcaagaaataattttaatgattaaaagactagcaaaatgattaaaattaactataatatagttaatcattaaggaggataatttcatgaatgttgaaataattaatgttgggacagaattgttattaggagaaattgttaatactaatgcaacttatattcaaaaaatgtgtaaagacttggggtttaatgtttactatcaaacgacagttggtgataatcatgatcgttttaaagaatgtctagatgtagcttttaaacgtggtgctaattgtgtaattacgactgggggattaggacctacccaagatgatttaacaaaagaattatcggcagaatatttgggtttagaattattatataatgaagaagaagctaaaaaggtagaagaaaaatgtcgatttgtaacgggatggggtgatattccggaaaataattttaaacaagctttttttcctaaagattgttatattttagaaaatgaagtagggacagcaaatggctgtgtaatgtcgaaagatgaaaagatgattgttaatttgcctggtccgcctaaagaaatgacttatgttgttgatcatgttttaaaagattatttaagtcaatttaagcaggatattatttacacatatgattttctaaccatgggaataggggaaagtcgggttgatgaggtcttagcagatttaattgatcaccaagaagaagttagtattgctctttatgcttcagaagaaacagtgcgggttcgattaggttgtaaagcaagcgataaagaaactgctgataaaaaaattgctccaattaagacagaaattgaaaagattttaaaagattatattatcaaagagaagaatttaaaagaggccttagcaaatataatgccatcttattggacaatttatgaatgtgataattttacgcttagagatgattttaatcttggtcacaaccatactgaagatacaatgaatttattaatcgattgccgtgaacatcctttaggatcaattattaaagtaacgattgattatcaaggacgaaaagatgttttcgaaatacctttattaaaagatccaactttatcatataataagttagaatcaaaaattattgagcgagtttataaatttttaactcaaccaggttataattaggagaataagatgctagaatttagatatgatactcaactattgattgaaggtaaaaatctcgatgaagatgttatcaatgattacattactgaacattttaaaggagattgtttgttagcggttggtgatgatgagttgatcaagattcatttccatactaacgaaccgtggcaagtgttggaatattgtgcatcacttggtgaaatctatgatatcgttgttgaggatatggaacgtcagtcaagagggttaaaaggataaataaaaaacgtcactaaattaatcagtgacgtttttagatatgtaaagttggatcattagcaattagttcaataaatttgtttgtagcaacagattgagttcgtcgttttggataagcataaccgatactgcgtttaggcaatggttgtgatgtttttatttcatgaagaatcccttgatcaagtaattcttgggagaattctttaatgacacaagaaattcctagtcctgctctggcaaagtccaacaataaattatgagctccaagttcaattgttggctttaataatagtcccttattagcaaagtaattatcgatacgattacgggtatttgatgacttttctaaaagaattaggggctgatcagctaattgattgaaggtgtaaatatgattatcaggctttttagaaacaaaaatatcatgaacttggaagcattctttaattactaaagaatcatctttgatgggaagatttaaaaaaccgagatctatttgatcagatttcaacaattcacgggtttctagactggttcggttgattactttgattttaaccccaggatatagttgtttgaatttaacgatataattagttaaaaaatactcactaaaagtatcaccggctccaataattaattgaccatcttttaattcatgataatttgataactggttttctactccggtaatcaatgctaaagctttgtcaatttgctgatgtaataatttaccctctttagttaaactaacacctttagaattgcgaataaataattgagtctgtagttctttttcaatactgctgattgtttgggaaactgcagattgagaaataaaaagatttctagctgcgattgaaaaagatagggtcgtagcagcttcattgaatattttgtattgttctagtttgatatacatataagttctccttatatcataattataatatattaattttactaatagctaagactataatataattattctgtaaactagtcaaactattatattaatgtatatttattgatgcattttgttagtttattgtatataatgtaatagtaaataagaaaggtgtgaatttaatggctggagttgttgtagtaggaagtcaatggggcgatgagggtaaaggtaaaattactgattacctggctcaaaaagcagatatcgttgctagatatcaaggtggtaataatgccgggcatacaattgaatttaatggtcaaaagtttgctttacgtttgattccttcaggaatttttagtggtaatgatgttattttaggtaacggaatggtaattaatcctaaagctttacttgaagaaatgaaatatttaaatgatgctaatattagcactgataagatcatgattagtgatcgggctcatgttatcttaccttatcatttagaaatcgatgaaattcaagaaactaggcgtggagctaataatatcggaacgactaaaaaaggaattggacctacatatgtcgacaaatatgaacgggtgggaatccgtatgggtgaattcattgatgaggaattatttaaagaaagattagaagaagctttggcttctaaaaaagcgcaatatcctgaacttacatgtagtgccgaggaaatctttgaagaatataaagaatatgctaaaatcattgcaccaatggtttgtgatactggtgttgttttagatgaatgttttcaaactggtaaaaatgtattatttgaaggggctcaagggacaatgttagatattgactatggtacatacccatttgttactagttcacatcccggtgctaatggagtagctgaaggctctggaattggcccattatatattaatgaagcagtgggaattgttaaggcttatacaacaagagtaggtagtggggctttcccaacagaaattgaaggtgaattggctgatcaaatccgtgaacgtggccatgaatatggtacagtaacaaaaagagcaagaagaattggatggtttgatgctgttgttgttaatcaatcaagaagaatgtcttcattgacgggaattagtttaatgttattagatgtattatcagggttaaagacattaaaaatctgtacagcttatgaattagatggtaaaatcatcaaagcattaccttcaacgattaaacagttgaatagggttaaacctgtttatgaagaaatgccaggatgggatgaagatattactaaggttacttcttttgaggaattacctgaaaattgtcaaaagtatttaagaagaattgaagaattgattaattgtccaattgtaattttctctgttggtcctgatagagagcaaacaattgtgttaagagaaatttttaaataggaggatagctagtgaaaaatgaattagtaattgtaattgattttggtggtcagtataaccaattagtagcacgtcgagtacgtgagtgtaatgtttactgtgagatttattcttataaagtagatattgaaaagattaaagagatgaatccgaaagggattatattaacgggtggccctaatagttgttatttagaagattcacctacttatcaaaaagaattatttgaattagggataccggtattaggtttatgctacggggctcagttaatgcagcatgtgttaggtggtaaagtagaaaaagctgatgttagagaatatggtaaatctcatttaattgttagtaaacaagaatctaaattaatgaaagatgtggcggtagagtcgatttgctggatgagtcattttgattatatctcaaaaattgctccaggctttgaaattacatcatacactaaagactgtccagttgcttcatgtgaagatgaaagtaaaaaattgtatgcaattcaatttcatcccgaagttttacatactgaatatggaacaaaaatgttatctaactttgttttagatgtatgtaattgtagtggtgattggcgtatggattcatttgttgaagaacaaattaaagcgattagagaaaaagttggtaatggtaaagtgttatgcgctttgtctggtggagttgattcatcagtggcagcggtattattatctaaagcaataggaaaccaattaacttgtgtttttgttgatcatggattacttcgtaaaaatgaaggtgatgaagtagaagcggtatttggacctgatggtcaatatgacttaaactttattcgagttaatgctcaagaaagatattatgaaaagttaaagggtgttgaggaacctgaggctaaacgtaaaattatcggtgaagaatttattcgtgtttttgaagaagaagctaaaaagattgggactgttgatttcttagttcagggaactatttatcctgatgttgttgaaagtggattaggtggtgaatcagcagtaatcaaatctcatcataatgttgggggcttacctgatgcagtggatttcaaagaaatcattgaaccattacgtgatcttttcaaagatgaagttcgtaaagtaggtcttgaattaggaatccctgaatacttagtatttagacaaccgttcccagggcctggacttggtattcggatcattggtgaagtaacagcagaaaaagttagaatcgttcaagatgctgatgcaatttacagagaagagattgcaaaagcaggattagatcgttcaatcggtcaatacttcgctgctcttacaaatatgcgttcagtgggggttatgggtgatgaaagaacttatgatcatgctatcgcgcttagagctgttaacacaattgatttcatgacagcagaagctgctcaaattccttatgaagtattaaataaggttatgtctagaattattaatgaagttcgtggggtaaatagagtaatgtatgatattacttcaaaaccaccaggaacgattgaatttgaataacattgataggtttgtaggtatccttaattggatgcctttttaatttgattaataaatgttaaaatagaaatttattaaagttaacttattaataagaaaagtaagagaagaacaatttaaatactatataagctgataggatactaattattactagtttgtagttttattggatactcgactcgtctgtttcatcatcaatttgttagattagcaattacaactttattatatgtaaaagaaatagagaatattttcaacagttacaaaaggaaatggaagaaaaatatacgaatttaagggtaaaataaattgattagggaatgctgatatcaatataaaatcatatatatttactcagcctttcaaaatagggaaatcagataatttgtttaagtaatataagttttaatgttagttgttagatggataaattattatctccataaaaatgatgaatgttctaaaaatatccacgattaaaactagtacctttttgtactacagttgtgttagaaatacaaatgggaaaacaatttatagtgtggtataatttataatgtgaaaaactattaaaggagattaatagccaagatgagtaaaaagagtgatgtattggaatcctggattatggtagagcatttatctgaaggagatataaacctaaatgataaatcgattataaccttgagtaatcttggagatgaaaactattatgatttgtttataagagaaatacagaagaaaaaaatgaagaaatatcagcaaggcggtatagttgtattttttgatatattttcatttaaagaaatcatcgattttttaaggaaagaatataatttattggaaacagaagaggatataaaggttggaaataaattttcgtttgccttatattttgataaggaactcaaaattcattcagaaatgacttttttaacagaaagtttttatatcagaaaatatagaaaaataccacgagaatcagaatttttatcgtttgaacaagaatatagaaagatatttgatgagatatttgaatgtcctgatgaagtggattatgtggatcatttcaacaatgcaataaaatttattattaaaaataatggtatcgatatcattaattgtaggatgaaagcaatagaaaatttagaaactgatgctactaaccttcattcattctttgtgggagatttagaaaaggcaaagaccatagagtctagtattcttgatgactatattttgaaaagaagaaaagaacgtgtcaatttagacagtagagtcaaatcaagtgaatttgattctgaagtatttagtaaaatactacagcctgaaaattatccgactgctagattcccaagtaacccagaatattccctaacatttatgcaacaggtggctgtcaatttagctattggatatgataatgaacggattcgaagtgtaaatggacctcctggaactggtaaaactactttattgaaggacatctttgctgaatttgttgtagagcaatcatatgatatagctagattatctacgaagtatgtaaaaggttcagaagagactaagtattggaataatgcatctatcggtattatgccaaagaaaatagctgaaaaaggaattgtggttgcaagctcaaataatggagcagtacaaaatattgttaatgaattaccacttttaacaggaatagacaaagagttttcaagagcacttatcgaagttgactattttaaaattattgcaaattcaaatgtttcatcaaaatgggttgaagatgaaaacggtactaagcatgaggaattagtaagtgaagaaaataaagaaaataataaattctggggactattttcacttgaaggtggaagaaaagagaacatggattacattgtaaaagtattaaaacatgttgtatcttatttggaaaaagagtatgaaccggatgaagagatttatcaaaagtttatgaatcaatataaggatgtatgtctgtatagagaagaacgacaaaagatatcagaaacaataaacaaactaaataagttactggttgaaattggtacacaacacgacttatatgttagagaatcagctaatagaaagaaggaaattgaagaagaaaaagctagtacattaaaaatcacgatagatattcaagataaaatagaaactttaaaagattcattgcaagaactttccaatctgcagtttaagcaatatgaagagcgggagtgtattaatcagtgtattgatgccttaaaattgcaaaaaccgggtattttttcttcgctaaagcgtaaaagagaatataaagagaaatgtaagttatactctaatcaacttcaaaaaataattttgggtgaacattcgtataaagcacaaataatggaacatgaaaataaaatcaagtctttactagatacaaaaagtaagaaagaaacagaacttaaatgcaagatagaattgtttgataaattgactcaaaaagcaaaagacgatataacatatatggaaaaacaagcagaagaactcaaaaagagtattgatgagaagaatattaataaactcgattttacgattgattatgaaactttgcaattaagcaatccttggtttgacactgaatatcgaaaccttcagtcagagttatttatatctgctttgaaggtaagaaaacaatttttatatgataatgttaaaaatataaaagcagcatatataatatggaataagcaaagagattatttatgtcataaaatggtgatttcagaggcttggaattggatcaatatggttattccagttattagttctacatttgctagtttttcaagaatgtgttttcatatgggcgaaaaaacaataggtcacttgtttattgatgaagccgggcaagcccttccacaagcaggtgtgggtgcaatttttagaagtagaaatgttatggtggtaggagatccttctcaaatagaaccagtactcactttggattctagtttgcttgatatgttgggagagtattatggggtatctaagttttttttatcaagtaatgcttctgttcaaacattagtagatgaaattagtaagtatggattttataaagataatactagagaagaatggataggaataccattatgggtacatagacgatgtaaatatcctatgtttgatattgcaaacaaaatttcttatggcggaaatatggtccaagcagaaaagaaaaatggaaaatctgaatggtttgatatttgtggtagtgcagttgataaatatgttgaagaacaaggaaaatttttaagagagaagattcaaaaaatgatttttcaaaatgcagatattattgataaagaaaaaaaagacataatttatgttattacaccatttaaaaatgttgcatatcatttatcacaggaacttagaaagataggatttacacgttatgatgaaaaaggaaaacctacaaatgtgggtactgtacatactttccaaggaaaagaggcacctatcgtctttttagtattaggagcagatgaaacaagtaaaggtgcagctaattgggcaatggggactgaaaatccaaatattatgaatgttgctgcaacacgtgcaaaagaggaattctatattattggtaataagaaattatatttaggattaaaaagtgatgttattaatgatacaaatgaggtcattaataagtttaataaatagtacaatagggcttctagagtttagccaataagatttaactagaatgcattatatggtaattgtaggcttaggagattaaaggcaaaagaacaaaggatagaaatgtatcattactataatttaattgatttatctaaattatgagagggaaaaatatgttttaaatatatctaataatattactttgataaattccaatttgtggagataatatttattactattgaccttaaaataaccttattttattaaaaacaatatgaatacagagaaaatggtgtaatacatgaaataagtaataaatactaatttaagtagattagtaaaataatatcaattcatggaattcaaataaagaatagtagtaaatggcttattggtgttctagaaatagagcacttttttatagttcaaagtagttaacttaataaaaaggataacttactcattgcattgcaataatagttcatattatgtgaaaaaaatcacgttttcaaaagctttttactcaaagttgatttttattttaaaagttttacattttcaaacattcacattaaaaagacttgattttatagtttgatttttgttaaaaaagtagtagtttaagctacttactttaatttggaaatatcgagtaaaagaaaatttggaattgctttagcttttgcataactatacttttcagccaacaatttcatgggcttgacattatccgtatcatttgtcccaataactgcatttgacgataattttgcaacatcatttaattctttattatctaaaatatcatgaggtaaataaggacttaagaagaaattttcagagtatgcgataattaggaagtttatgatttctagcttttcttcttcattcatttttctgaattccttataaaattttctatatctacttgcatctttattgtgaacaaacattatgattgcagtagatgattctaatggaaaaacgcatatatgcaagtccttagtatgataattaggttcaaaattgtaaatattattaatgatttcattatcaaaactattaattaaagcaattttgtcttgaaaagcgattggcacagtatagtcaagttttttataatatattaaaaaataatcactccaatctttttccaaatttctctttgcttttttatacccatcataatattcctcataatctaaatattcagcttccattaattgcattatataatcaacatttagaccagtttttttaaacatttccatttcaacaaattttttattaattgctaaaagataactttttagtgcgatttgagatagcatcttttgactcggactttgagaagtatcataattttcaggattttcatagtctgcaaaaatagtattatcacaatttttacaaataatttgaaaagtgcctgttttttgtaaaccactttgcttatcttgaaaaggtatttctatgaaattatttagattaactaaatttccatttttagcaatatttcttaatgtaaatgcaggaacggaatgggagttgcaaaagctacttacttcttttttgcaatgaaaacatttatttcttttagcagcactcctgctttctttcataaatttactaatctttttgcgattttcaactgttacctttttttcatctatcgaagaaaactcaaacaaacttctcatttcatcttctatatcattcattttagtacctccattaaataaataccatttcaaataaattataaactcattactttttagtttgtaagtggttacatctaataatttatattacctgtatctccaattctcaagccactgaaccattgtttttccaagtttatagacaataactgtattaacattttttgcatagtctgggaacatttcatctatattttgatttactacatcttctttaaactcattaatatgtgttttagtatagcctataaagtcaacgtgctcttgtttagatttaaatacgggaataaccgctagagctttatcgtaacttaggtccttatcttgataacattgtttatcaaaaaaaagattaaaagcaagatattcaatactgtcttgtatataggcataatatttaatagaatcaccaatgtcattaagagatataccaaattcattatcccaatatgtattaggctctatttgataataagattgtcttgtggattgaacaccataaagagaaatatctaaaactctaccatttaaaaaaatatcccacttcgctcttctgcctatttctccctcgccaatattccaattaaacacattagcaaataaatatggaaaatccatcacccatatttgtgtttctgatttatcttttcctatatttacttccaagttataattatgatcttgtttaattacaatatctccatattcgctgttatgaaaagtctcatattcatcagttgaataccaatgatttttgttttttaaacgtttagttactttatcactatctgtgcctaccaatccgaatcgttttttccacaaaaactcagttgcttgttttgttgcacattctgctgaacttgtatttctatcctcaactctactataaataactcctgcatggactatggttttatcctttccgggagtgttttttacatagtctttcagtaaataatagggtgtaacattactattatgaataattaaaacatcaatttcttttccgtagatttgtatgttttttacttctatatcaggaatttcttcaccagaccagatttgagagttaagaaaaccaatgatattttcttggtttttacgattaatatcatctataacaccagtaatcttgaatgtcttatcttcaataccaaaaattatatatccatcctgcatatcaacagttgtgttgttcgccatgcaaataatatctttaagtaaatctgaattattattatgccaattttgtttaaaatcccaataactgccttctgaatgttttttgataaatgattccactatatattgtaattccatctctttctcctagcctattttatatgtattattgcaatttgtataaatttattatagcagttttgacattgaagcagaagaattaatatattattttatattctttgctttttttaatcttgttacatgtaaggaaatcatataatttaatattcgctgttgattatataaatatgtgggataatatatctattgatttatataattattacttatatagaaaccagaaattgctatgcaagaagattgaatttctaaaatttttagatcttattcatggagtaacgatgcacttgttgtattaatcctattttgtagttttgtttttacacataaaaatcacataatattctgatactaatttgatatcgctaacttgtataatcagtagagttagtataaagtaaagttgaaaaaagatatgtatattatacgaatcaaacaaatgtgtttagtataattaatctaatgaagagtttgagtagtacgaaagcgtatcatttattttatatggcaggtagtctatatgattgcctgttataaattatttattttgtaatgttttatttatatctataccgttagttggattttgtaaatcatctcaacaaacaaaacaaatagttcctataattattactaatgttagcccaataaccatgtttaaccatggatgacgcttagaaaaagcatctttaacgtttaccacttttttatccttgtattttccagccacccaacatacaaatatgcttatcaatgaacccgcaaaaaacatattagtatataataataaatgtgtctttttatactcattattgtttaaacaaaaaatcaagattataagtaggtgtcataaattgtataatgagatttacaaattaaaatttatgagataatattcattattattgaccttaaaatgaccttgttttattgaaaacaacaaaaatattatgaaaattgtgtaatagataaaataagtgataaatattaatctaagtagattagtaaaaagatatgaattcatggagtttgaatagtaaatagaatgtaaaaaagcctttagatgatatgatgccccagtaaacattgtaaataattaaacactgactataggaggtttttacttactataggtagaaaattacaatattcaaaagaaataaaaatatgtactgtaaaacgttatttgtcagatttttatttgaataacatagatgattccaaaagctattttgaaaattgaaaaaatgaagatatttacttgacaggatggttgcgaagatatttttcaaaagtcagaagtaaatttgaaattggtgaattagataatagtttaagaagaaaagaattttttataaaagaaaattttcaagaataaatagatgtaaattataaaagtcaagttctttggttacaaagaatattgacttttttaatacactatattattttgtgcttactatttataaaaaagtatttcatatttataaaaatatattataatgtaaaagcattaaaaatgtaaatatataggggaagaaggtttgatatgattaaattttttaaagtaaacatagaacctaaaaaaaggttgagaatgatagaagtaatattttcaataggattatgtattgcttcaattatatcaattggatatggcttgtttgatattaatgctaatattgaagatatacagtttaaacaaagtatccagatgacaagagatactgacttagaagactacagtgaagataacacgatttgtgatgttacctatataaatggtgacaagcagctaattgtatcttattcatatgaagactatgttaaattagatgataagacaattacagcatatgaatacgaaacaaaaaatgggacaaaattatattttgatcaccaaaatataaacgatcaagaagtacagtatgcctacaaacaagtaagagctaatgaattagcctcattatttaactttgggattgcttctttaatcttgatgttatccattttaattatgatgttatttgcgaaacaatttacaacctatgaaaaatcatggtttatttcgatcatggttctagcaacgattttttccgtagttttcccagaagaaagtgctaatggggtaaatggaattatcattatgttactttatttattggatacattcttaaatattctttgtgaattattgatttctaaacaatcacgatataattttcttgtgtcgatattagttgaaattgttgaaattgctatatgtgtagtattaatgtatcgatttgctacaatggcaacaacattatttttctggctgccaattgatattattagttacataaattggtcaaaacataaagatgatgaagaaaatgaattaacagtagtaagaaaactaagaggataccaggaagttttagttatcatcggaatcattgtttggacgtttgtaattggatatcttattagtggtttaaatattgccacggatttctacaacaatgaattattagaaacattcattatctatattgatgcttgtgcctcagcagtagggattgcaaatggtttatttattttctttaggttgcaagagcagtggattgcatggtatatttgtgcatttcttgaagccgttataaatattatttcgggacaatatgttttattagttctaaaactaggctattttactaatacaacatatggttatatcaagtggagcagatatattaaggaacatacaacagagaaacaagcacaaatatcataatgtgtcttgaggaatgatgttaaaattgatagaataaagtatatattaatatgagcaagattaggagtgaaaatatggctatattagcaggtgattttaaaacaggattaactttgattgttgatggtgatccttgtcaagttatggattttcaacatgtaaaaccaggtaaaggagcagccatcttaaaaacaaagatgagaaacttaaaaactggagcgattcaagaaagaaactttaatgcttcgactaagtttgaagcagcaaatatttcaagaaaagatgcgcaatattcatatgaagcagatgctactttttattttatggatctagaaacatatgaaacatatgaattggcagaggatcaagtaggggacaataaatattatattattgaaggttcaactgtttcattaatgttctttgacgggttattgttatcagtatctgttcctgaaaaagtagaattaacggtggttgaaacggatccagccatcaagggtgcaccatctaaccagacaaaagatgccgttactgatacagggttaacattacgggttcctcagttcattgatactggagaaaaaatcgttgtgtttacaactgatggaaagtatgctggaagagcttaataagctcttttttaaaattatgaataaaattgtattgattactgggggagctaaaggaattggcaaagcaattgctttagaattggcaaaacaaggatatgatattgtaattaattatttaacatctaaaaaagaagctgaggcattaaaaaatatgattattgatgattatggagtacgttgtttggctattgcaggagatgtttctaaggaagataaagtagatgaaatggtatctttgattgagtcaaaacttggtggtgttgatattttgatcaataatgcagccgtagatttatcaaatttatttcatttaaaaaatgctgaagaatttaaaaaaacattagatgtaaatgtagtaggagcatttaattgcagtaaacgtgtttatcgccatatgatcgatcaagaatatgggaaaatcattaatattgcttcgaccaatggcattaatacctattatccgatgtgtattgattatgatgcatctaaagctgcattgatttctatgacacataatcttgcctttgaatttgcaccttttgttaatgtaaactgcattgctccaggtttcattggtacggaaaatgaactgaatggttatgatgagcaatttttaaaagaagaagttgaaaaaatcatggtcaatcgctatggtgatcctcaagaagtagcttatttagtaaagtttttagtaagcaaagaagctgattttattaataataccgtaattcgaattgatggtggacaaaaaggaagttgctaattcaacttccttttcatatttgataatgctaataaaatagataattttccatactcaaaagttaaaccgccttgcagatataaggtatatggttcaataactggggcatcagcacttaattcaatcgtactgccttgagtaaagctgccggcagccataacttcatcaaaaggataccctggcattggagctggtaaaacatggacaaatgaatcaatcggactagtttgttgaatgccttgagtaaagcttactaaattctccttagatttaagttctaatgtttgaataatgtcagtccgtggttcatcatagcgaggagatacgtttgaatattctagtttttccaacatataagctgtaaatatagcagtttttaatgcgttttttacagcattgggtgccataaaaattcctttaaaaaaagcattgtttaaattgaaattagcccctaaatcttttccaattcctggagctgttaatctttccgctaccatataaactaaattttgattaccggctacatatcctccagttggagcaatcccgccaccaagattcttcattaaagatccgacaacaatatcagcaccaacatgcccgggttctttggtttctaccaactcgccataacaattatctaccataataattacttcatcatttacttcacgaatctttttaatgatccgttcaatctttgctatcgataatgacttacgatgcgaataacccctagatctttgaatttcaactaatttaatattcttttcttttaagcgttcaataatcatttgatcatcaaaatcgtcattaattaattcaatttgttcatacttcactccggcagcttttagcgactgacttgaatctccgcttatcccaatcatttcctgaagcgaatcgtaaggagcaccagacaatgaaatcattgtatcaccatgtttcaataaggctgaaagagttatgtataaggcatttgttccgctcataatttgaggccgtactaatgcatcctcacaaccaagaaccgttgcaaaaatcttttcaatcttatttcttccctcatcatagtttccataaccgttgatatcactaaaatctgagtaagagactttgttttcaataaaagcagataagattcgattagaatttgttagacaaatagagtcgatcttttcgtagatatcatgtaaaactgtatcagattctttagctaaagtaagtagatccggatttatttgttcaagtatcataaaaaacctcctataaataatacattgtttattatacacattttttgattaattgcattggtataatatctgttaactataatctatctatcattgagtgctcatattaatgagcaacaaatgatgactgatgaattttttctacccattaatatttataaattagatgatgagttgaaaatttaatcaaattaaacaccatggacgctcttaattgagctctctaaaaaattgcgggataaaaattaaatagctttaaatacttacggggtcaatgccttaaattgactttattagattttgaaatatggattattattgaaaatttataaattaagagaagtagcgcttatatcttaatttaaaaagattagtaaatttgtatgaatttgacgagttcgaataagaatatgatagatatgcgctttaaaatattgattacaaattattaaaacgatattgaatggtactagcttgtgatatcaagttattatcaataatttgcataataattgtgcttagcttagcaaagcaaaccctttgtaaaatttatagaagaagttgaggttaaaaagatcaatgagatatattttgaaaattattttttgatgcaataaaagtcaattttcgaaagccttcattttatatttgattattattgttttgtacattatgagtataagttttcattatatagaaagtaattatttatattatattgatatgaataaaagagtagatttacttaaaaaaatatctagtttagattttaatttattaaaatctaaagatataactaagagagagtatgatgatattttggataagatgaaaaatcatcacagtgatagttgagaagtcatagataataatataaaatccatatctggtccgtttctaccatttttagtaatgctatttgttccgtttatgaatactttcaagagtaatgctcaaaaggtaggagctattattatgatgctaattatttctataatatttggtttttaggtatgattatcccaccattgcctattagatagttaaattatgtgatactaatatctatagaaatagttttatattttttagaatattttgagtgcttaatttttaatagtcatttagaataatattgaaatataaatatatagataaaagaaatatgattacaaaagagtgactgtctaaactaataagacaagttggtaaaaatatttattttttaagcaatgagaacatatgtggtatataataaaaaatgatatattctataactacaatgataagttgtattaaataaaggttattagaagtattttttgtaaaaagagaatattgagtatagaaaatttgatggacttatagtcctaagagctgccatatgtaaatcagatacatctgttttttatgaaataggatacaaaattaatgtgctattattatgatgaagatttaaaattttttaaggatggtgatgaaattatgaaagaagtaatcgtttcagcaggattagtatacatatatcttaatggatatttagaaaatgaaaggctgcatattcaatccattgatacttatagctgtttagaaaatggcttttatcaacgtgtaatagaggcttcaacaatagctaatgaagttgatgaaatagtacatatttttgctgttgttggagttaaagaaaaagcaaatcaaatatattctatgatagagaaaagattaaagaataattttaataatattatagctgggaaaaatattaaaaaatcttcgaaaatgctagataaaacaggtaatgttttttttcgctgtgttcaagagtttttttgtgaacaattagatcattttcctaaacaagttaattacgattttaacgattttactatcaaaggaatttgttctagccgcttaccggattatgtaggagattctattacgaatgaaattatttatatatggctagaacgcgagaaaccaatgttgtgtggtagacaattgatgataagatctttctttgtgcgtgattttattgggagaaaagttatagcctcacttcctaacaaagagaatgaatcatggcgattcatttttgaagggggtcatcagatttcaatgaatgagaaattttcttatttaaaagaaacattacatccagatgatttaggtggattctgttcatcaaatatacaaagtatattaatgaacccaatttatgcatatggtcaatggtttcaaccaaatgatgtttgcgaagaatggcataaagtgtttctttatctatgtgctatttcagataatgagtggaatgaagtaagtatctccaaaatatatgataagtttttagattttcttcgaaaaaatatatgtattacaatggaggccccttctttaatttctaaaagtgaatattacaaaatattattgattcatattgtaaatttccgtagtttccttaaaggagaagatgagccagtactttctaaagatttgctccaaacaatgaactcaaggtatgtatatttgccatatctgtgggaattgattcccccaaatacatataaaaatagattttcagctaataattttaaaaagcaaataaatgaagctatgaaagaaaatgattcttatataaaaggaattctttgggaaaatgctatagcatatgtgttaaacaatatagaaggtttaaaaatcactggtagaagaattcggacatgtaatcaagaaatagatatcagtcttgtaaatatatcattagatgatcaactttggcaattgggagcatatatcttggttgaatgcaaaaattggagttcgcgtgtaggcgtacaccaaattagaaatatcgcacatatttctaatttgaaaggaaatagaacagcaattttatttgcctcaaacgggataactagcgatgcacaaagagaaatctatcgattggcaattgaaggttgttttattgtttgcgttactgttgacgatcttcttcaaatgacaagtgctaaagagtgcaaaatacttattttagataagtggaatcttttacaagaaaatgtagaattaactacgatattataattatagtataaataatttccatttgttgtctatttttactaaactataaaaatagtggttaattttagtgaaatcaatatttaaataagataataatataaaagatatatgtgttaattcatacagtttcataaataatggatgattctaattaatgtattatttgaagctgcatattatttttggagtttattaatatcaatgaaaattaacatataattttgttttcattaatttattgatattatgttatacttaaataaatagtttttaatttggggtgaagttatgatagtatatcaagaaacaaaagaacaatttctattagatgtatataatgataaaatagatgaaaaaatagaaaaattagtatttgaaagattgaatagaagaacaggctatagcgaataccaaacatggatgaattcaatgcaatacatgtataaagtattggaaaataaagctataccatcaaatagtattgttgcaatagagtacaaagtacctaattctaataaaagaattgattttattgtcagtggtgaagatgaacaaggtagagaaagtgctataattattgaattaaaacaatggcaaagtttaaataagattgaaaatatggatggattagtagaaacgaaattaaatggtcatttaacaccagtagctcatccatcatatcaggcatggtcatatgttagtttaattgaagattataatgaagatgtaagaaaatataaaattaatttgcagccatgtgcttatttacataactatcgaaagaaagaatatgatgatttagtagacttatgttatgaatattatttagataaagcccctgtttttacccgtggtgatactaaaaaattagcaatgtttattgctagatatgtaaaaaagggcaatcctgatgtaatgtatcatattgatagtggtaaaattaagccgagtaaatcactacaggatagtttaactaatatgttaaagggtaaaccagagtttaccttgttagatgaacaaaaagttacttatgaaaaagctcttgctattgctaaagaaaattctgctagaaaacaagtttatattattcatggtggtcctggaactggtaaaacagttatcgcagttaatatgttagttgaattgatcaatcgagataaaaatactatttatgtaactaaaaattctgcacctcgtgaagtatatcaaaagaaactaactgatggtggatataaaaaggtttatattaataatttatttaaaggttcaggtgtttttataaatgcgaatgaaaatgattttgattgtataatagttgatgagtcacatcgcttaaatgcaaaatctggaatgtatcaaaataatggagaaaatcaaattaaggagattattaatgctgccaagttttcaattttctttgttgatgatcatcaaattgtaacaaccagtgatattggttcaagtaaagaaataaaaaaatggtgtaaatattataatgctattgtttatgaggataagctgacttcgcaatttagatgtaatggcagtgatgcttatttatcgtgggtagataatgttttagagatagaagacactgcaaatgatgaactggatattgattatgatgttagaatctttgatgatcctttagcattaaaaaaagctattttcgaaaagaataaaattgctaataaatcaagaatgttagcgggctattgttggaaatggcaaaaaaatggtagaaatagatcagatgttcacgatattgaaattggagacttttcgatgtcatggaattttgcatcaactaaaacttgggcaattgatgaggaatctataaacgaagtagggtgtatccacacaagtcaaggattggaatttgattatgtaggagtcattattggagatgatttacgttatgaaaatggcaagattattacagatttttttaaacgggcacctacggatagatcaattcgtggtttaaaaggtcaatataaaaatgataaagaaagtgctctaaaattagcagatgaaattataaagaatacatatagaacacttcttactaggggacaaaaaggatgctatatatattgtacaaacaaagaattaaatgaatatctaaaattaaaacttaaaagaggtaaagagaatgttagaaaaagttagagaagagataattaagtttaatcaggatagggattgggatcaattccattctccagagaatttagcgaaaagtattgcaattgaatcaggtgaattattagagtgttttcaatgggataatagctttaataagcaagatgtatgtgatgaattggctgatgtggtaaattattgtattttgatggctgataagttagatgttgatttggaagatatagtattaaagaaattgaaaaagactgaaaagaaatatcctgttgaaaaagctaaaggaaatagtaaaaaatataatcaattataagctttgtatatataataaagtgttgtataaatatgctgttttatattaaaagatatcaataaattttgatatgaggaatttaaagagtattaaaatcgttacttaaaattaaaaaaattgagagttctacccattgcattttatttgggtaataatactgcagtagaaatgaaaaaattatataaagaggataattttgaagaaaggataaaaggttagttttaaaacattttatcctttttatataaaattttctaaattacttaataaatatttttgattatctcagtaagcatagatgatttgcatatatcctagacatttactatctaatgatgataagatagttgttagtaaataaaaaattagtagctaaaaaagagaggaatctaattatggaacctaaacataaaagaaggattagatataagggaacgcatcctaaaaaatacaatgagaagtataaagaattaaatccagaattatatccagaaacaattgaaaaagtaattaaaaaaggtagcacgccagtaggtatgcacctatcaatcatggttgatgaaattttagaatttttagatattcaagaagggcaaataggattagattgtactttaggctatggcggacatactttaaaaatgctggaatgtttaaattatactggtcatatgtatgctttagatattgatccaattgaaagtataaaaactaaagaacgcttattaggtaaaggatatggcgaagatgttttaacaataaaaaattgtaactttaaagacattgatatcatatcaaaagaggttggtttgtttgattttgttttagctgatctaggggtatcatctatgcaaatagataatccagaacggggcttttcctataaaaaagagggtcccttagatttaagattaaatcctcaaaaaggagttccagcatctattaagctacaagagttaaatagagatcagttagagcagctttttattgaaaactctgatgagccatacgcaaaagaaatagctagaaatattgattcatacttaaaatcaggccaattaattacaacgacaacacaactgtataaaataattgaaaaaagcctgtcttctattccagtgacagaacgaaaagacatagtgaagaaatcagctgcacgggtattccaagctttacggattgaagttaatcgtgaattcgatgtacttttagagtttatggaaaaactcccaacgattcttaaaccaggtgcaagagtggcgatattaacatttcattctggtgaagatcgaattgttaaaaaggcatttaaagaaatgaaaaatcttggactatatagagatgttgctagaaatgtaattagaccaagtaaagaggaatgtcatatcaatagccgagctaagtcaactaaaatgagatgggcaatcaaagcataagtatatttggaattgctatactttaaaagataactaaactaatatattaataatagggggaatcaaaatggtggattttagtgatttaattatcccaacattggagattttatatgaatcaaaaaaagagatgtcaattagggaaattgatgagactttaattagtcgattaaatataggcgagttagatttaaaattaaaacataaagataccaagcaatctgaattttcatatagatcgtcatgggcaagaacatatctaaaaaaatatgggctaatattgaatattagtcgaggaatttggaaaatcagtgatatatataatggagaaaacattgatgataaagcggttgttttggcagtaagaaataatcaagtatatattccgatttcaaagttagaagagaatatagatatcattgaagagaattgtgatgatattgcagctaataacgataagtacataaaagaattatcaaaaaaatatcataactataaggtagcattatttttaggtgcaggggtatcaatgtcagcaaacatgccatcttgggatgagttagtagctagttttttagtaaataggtttcgtaatgaatcaaagaaaaatttggatgataacattgttgatgaattagcaagaatagcaaaacttaatagtgataattcgccaataagccaaactagattcatcaagcaaaatatcgagccagaaatatatcttgaattattaaaagaatctatttatcataacgagaaatcaattaatattaataatgatttatttgaagttttaacaaatttgatcagatatgaaaattgtgtctacattaaagatattattacctttaattttgataatctcttagaaagaaaatttgaacaaaaatatattgcatatcaaaaatttactaattatgaagaaatacaaaatcaaaattatgtcaatatttatcatgtacatggatatattgataaagaggctacacctgatgaagttgatttagaaagaattattttttctgaagaacaatatcataaaatgtataatgatgtatataattggtcaaatataaaacaaatcaacgcattaagagaaaaaaattgtttattcatcgggtgttcattgtctgatccaaatatgagaagactcttagatattgcttatgataaaagtgaggctaaacattatgcaattctaaaaaaagaagatataaaattaccaaattcaatgagtaaagatagtaatgcatatttactctatcaaaattttcatttaaaaaatcgaaatgattattttaatagtttggggataaatgtcatttggatcgatgattatgatgatattcccaaaatactcatggaaattattaatataaaataaattctataataatttttaagtaaaacaaagcttgattaaattaattttaaaatcatataaataagagggcaactttaaatatattagattttgtagttgtctttttatttattttgatattcatctttaaggggtttatgaaatagtttctttttatgttttcgacaggcatcaaggtcacagttttcacaacttaaattattgttactgattttataaaagtgttctggatgtttataatgcatgtatacccattcaagcatagaaaccctaaacaaaaaagccaaattgtatatggtgagggaataaagataagaaaactatattgaaaaaaagaatcccaattataaatatgacattccatacagcattcgggtttaataaaaatagaattaaaagggcaccagccaaaaatagcaaaaaatacagagaagttagatagagcaaagaaaacgaaaatccagatccgttctagataccctgttaaatataaaaatcctggaatcaataggaaaataagctaaaaaaccaataaccaaaaagctcttttattatattcttgaacgatgtttttaaagtttatctaatctaactgattattaggaaagtatttttttgaaaactgacgacctttatatagggtagtgttaaatgcagctatcatatctttaataggaaagattgtaaaatagatagttgttaaaagatatacccaagaggttaagttaaaaggaagattagggttttttaaaagacaatatatagcaaatacgaataaaaagccgctagaaaagactctgattcgattcatcgtattttaccgtagatcatattttttgattgcttgtatattttcataattacctacctgaattaatatatacatgattaaattgcctaatatgacgttctaaaatatctattgctttttgctcgcgttctggggcgccgtcacatagtgaaataagaaaatagattggtccataaaaatggagggcaataatataagaatcttcgtttttttagtatgtcttgtttagttaaaatagaaaaaatatattgctggtatgataaggaataatcaaaatactgtttgatatattggtctgctaaattcttatttttaaattgttcgattgtaagcatttttctaaatttgctttgcaccacatcatgaagaaaatacgtaaacatatttttacctatattgatcaattccagttcatccatgttaatgagacggttcatatcttgtttaggcgatattccggtcatttttaatataattgcatcaaaaatttcttgtttacttcgataatgtttatacagtgatggagccttgattccaacgatttgagcaatttggttaacagttattgcatcgtagctattttttgaaaataaagttagtgcttctaataatattttttcttttgttgaaatcatttcctcccctttttagctaatagttattagttgccaaaataaatatatttaatagtagaagtttaaatatgagaaaaaaatatattgatgtaagaaaaatttcatattcgtgtttttttgataaaagaatgataaaatattaaaaaatataaggagtggaaacatgataaaaataggaattgtaggatacggaaatttaggacgtggggtagaatgtgcagtattacatagtcaagatatggaactaactggggtttttacaagaagaaatcctaaatcagtaaaaacacatagtgatgtacctgtttatagtatggataaagtttatgatatgaaagatcaaattgatgttcttgttttatgtggtggtagtgccaatgatttaccaaaacaaacagtagaattagcagaatattttaatgtagttgatagttttgatacacatgctaaaatccctgaacattttgctaatgttgatgaggcaagtaaaaagaataaacatataagtattatttctgttggctgggatccagggttattttcattaaaccgtctttatggacaagctattttaccgcagggtcatgattatactttttggggaaaaggggttagtcagggacattctgatgcaatcagaagaattgacgaagttaaggatgcaagacagtatactattccagtagaagctgctcttcaaagtgttcgtaatggggagaatccaactttagtaacacgtcaaaaacatactcgtgaatgctttgttgttgctgaagaaggggctgatttacaaagaatagaagaagaaattaagacaatgcctaattattttgcagactatgatactactgttcattttataagtgaagctgaattattacgtgatcaccaaggaattcctcatggaggggttgtattaagaagcggtacaactggattcgaacaagaaaacaaacatgtaattgagtataaattaaccttagattcaaatccggaattcacgtcaagtgtattagttgcatatgctcgagcagcgcatcggatgtatcaagagggtcaacatggatgtaaaactgtttttgatatagcgcctgcttacttacatcctgaatctggtgatgaattaagaaaaaaattattatagtaaaattttcaaatttaataaatctaaaacctactagtagatgttatggtatggtacttctaaagcagactgtgtaaataaatgaaacgctgaatattaaagaggcatcagatcattaactactatgtaggtttttattagaaattacagttttctattttaattatgtgatcaactaattcttgataaaaatcaggctcatggcaaactaaaatagcactactagaataatttttaattgcttttgccaatgctttttttatttcttgatctagatgattagttggttcatctaaaatcaataaatggctagtaataatagcaacatacataattttacttttgtctgctcaccaccatttaattggataattggtttatcaataagatcggttgtaatattgaaatgtgcaagattggttcgaattgtcttaatgcctaatttaggatgactatcgtgaactatttctaacggtgtttgataatcattagtccaaattaaatcttgattataataagcaatttttatttgatcattaaaaataaaggttcctgatatcagaataatttcacctagtaacgttttttaagtgttgattttccaacactgttaaatccagtaatggcaatttttcttgagcggacagtgaaaagctgatctttgaaagtaaaggcttatgatatccaatcgttaaattagctgctttaagaatttgtttcgttaaaagtggtagatttttaaatttaaaatctagtattataattgtaataggtgatgttagacgttcaaagtgagctaattgtttacgtcttccttgagttatttctgaattattcccagctatatttttgcggataaattgttccgttttttatatgtttttgttgtttttgataacgtcttagataatcagtgcgaagacgtttttttgttttaaaaagatgaatattttccacgatattttttattgtataataatcaatatctaaaatacaatcagtaattttatctagaaaatcaaaatcgtgcgagataacaatataggtgcccataaaattatttaaaaagtcaactcgctaattaatatgtttagtgtctaaaaaattagtaagttcatccaataataaaacatctagtttttctaataacaatttagctagaatcactttagcacattgtccaccactgattttattaatttttttatcaagtccaattagattaatcccaagtcctgcagttaccatatttattgaagtatcgatagtataataaccactgttaatcaatttttcttgatatctaccagctaaagtcaaaagttcttcattattattaaaacttctttttttgatacagtgttagcattttttgttctaaaaaatattcttcattgtagacaggactaagatattctttgattatttattcttgattaagagtagcatattgattaaggtgggcgactttaatattagaatgccaaataatttgaccatactctggtaaataagcaccggtaagcaatttcattaatatgctattaccagcaccattggctcctaagatgactatatgttcatttttatatcatattttatctctaaaatcatgagataaatctttaattgttaataaactcattttctttttttcctatctaataaagcagtaaatattaacataaatattaccttctgcaaatgaatatataataaattaaagatactgtcaatttcagtcaataaatgtattaaactatattttttaataaagtgattacttgatataaatagtttttcatatttataaattttcttaacattgttagaaaataatgtataataaataaacatgtttaaggagggaaaatgatgaaaaaggatatgacgacaggtagtcctcttaagctgattattgcttttgggatacctttagtaataggtaatatttttcaacagttttatagtatggttgatacaattattgttgggaaatatgttgggaaaacagctttagcagctgtggggtcgaccggatcactaaactttatgattattggttttggaattggtatatgtagtggttttggaattccaattgcccaaagttttggtggtaaaaaaatacaagacatgaaaaaatacatagttaattcattttatttatgtatgttgattacagcaattatgacaattgctactgttattgctttaccatcagttttagagttgatgcaaacaccaagtgatatttatcagcaggcatatgattatatcgtggttatctttattggattatttgccacaatgctatataatattttatcaagtattttaagagcaatcggagattcaaggacaccgttatattttttgattttatcatcaataattaatattgttctagatttgatttttattactcaatttgatatgggagcagtaggagctgcctatgcaacagtaattgcccaatttctatctggagcagcctgctatatttatatgaaaaagaaaaccgacgttttaactttcgaacatgatgataaaaaattcagtaaaaaacacagtattcgattattacaaatgggcttaccaatggcaatgcagttttcgattactgcaattggcagtgttgtgattcaatctgctgttaatactttaggttcagatgttgtagctgcagttactgctgcgattaaaatttctgttatgttgactcagccattagaaactttagggttaacaatggcaacgtatggcggtcagaatttaggtgcaaataaaataggacggattttcgccggattacgagtaagttgtattattggcgctgcttattgtgctattgtatttatatttgtttactttacttctgattatctatcattgttatttatcgatgctaaagaagttgttattatggcagaaattaaacaatatttgttaattaattcgatgggatattatatcttatgtattttatttatattgcgtaatttactacagggattaggttatagttttttagcaatgtttggcggtgttgcggaaatgatagctcgctgtattgttgctttcttttttgtttcatcatttggttttaatgcaatttgttttgcaaatccattagcgtggctttttgcgaatattgtctttattggtggatggatttataaacgtaaagaattaaaagtaattcaaagtagcgaggaagtaacagtttaattaacaattcgtttattttttcccagcaatagtaactaacggtcaattgtatcttagaatgcatatgttattatattactataatgaggtgaaaattaatgaaaattaatgaaataattaaagaaaagcgattagctttagggtatacacaagagcaattagccaagtttttaaatcttactacgccagcagtcaataaatgggagcgggggattagttatccagatattactattttaccagctctagcaagaatcctaaaaacagacttaaatactctattgtcatttaaagatgatttgtcagattatgaagttgtgttgtttttaaacgatttagctgcaatcaaagattttcagcaggcatatagaattgcaatagataaaataaatgaatatccaacttgtgataatctaattgttaatgtagcagttgttttagaaggattgctttcattaaacgagatggatgaagctataaaatatcagcaaaaaattgacagtttattggaacagtgtttaactagtgacaatccaatgattaaaaatcaagctcaagcagttttgatcaacaagtatattaatcaagggaaacttgaacaggctgagaagctaattaatgaattaccagaacaacatttaatagataaaaaacaaaagttagtcaatctctacatagctcaagcaaaattagaagcagccgctaaattacaagaagaaaaacttttagtgacagttaatgagattccaactatgcttttaactttaatggagattgcaattaaacaagagcggtatgatgatgctgaaataatcgccgatatatataaagaaatgcatgaagtttttggattatggaaatattctagttatactgcacattttcaattatgtataaatcgtaaaaaacggttagagtgtttaaaaatattaaaagaaatgttcaatgcaattaataaaggatggaatatcaatacttctcctttatatcgccatattacagcaaaaaaaattgatcagacctttgttcaagaaatgaaaaatatgcttgtgacatcaattaaaagtgatcctgattgtaaatttattaccgatgatcttgaaatgaataaaatcttagaaaaatataaatgatggttaaatatcatcattttttataatatttaagaatatgcacaagtaattcacaatttgtgaattactctgtgattgcaaggtagtcgcgtatcatttagtattaaacataatgtataagaaaaggtgaataacgcgtttctttataagcttagatatgttacaataatatccttgaaaatcaatttgaaagtcggtgagtatatgactatagaaactaatgataatttaaaccagctaataaaagcatacaatcatgatattgaactcaatcgtttaaaagatattcttgattatttaaaatcaaaaccaatttatatgccttcgacaattaagatttcaaaacaaaaattactaaagatccccaatgatgatctaataatgattttagataatttatctggagaaactactcaaaattatttacctgtatattctagtcctgttttattcaattcaaaatatcgctattttgttactttgagtatttatgattgttttatgttaatgaaaagatttaaagagaaaaatgcaataattattaatcctaatagggataattcattagttattgataacatattaattaagtatttaaaaaatggcggataaaaactaaatttatgtttattgatccatatcgcagcttgtaaatagaaatgatatggatcatttaattgttgccttttaaattgtatgataagataattttaatgataaataggtatttatattacatggaataaagaaatagaaaggttaaatggaaacgtaaatcaaactattgaaaagaaaggggatagaatctatcgtaacagctattggaaaccttatatccatgatttttcacaatatttagaatttaaaaagtgtaatagagttccaagatttttaggcgatgatgaaaataatcgtgagatattatcttttttgcatgaatatgtatctggtaacaacttttttaattgtcatgcaattgtttggacagattatattgtcacaatgatgctagttatcagactaattcggatggaacaataagagattataagacaaatgatactttgtttagaaaagaaagaataaaaatattttttaaagcttacggaatgattataccagataatctctttatttgggggatatgttgaatcgaagaactttgtaatttgactaatcatgaggtattggctggaaataaagcttttcaaaaaataatgagattaattattatcaaaatgaaattacttttataaaaaacaatagtaaagcctggtattgaattatgaataggagaaattggatgaatttggtgacaacaatgttaataaatgtaataaataattctcacaacagtgtagttgatcgtgatattgctaaatatttaatagcaaatcacgaaaatattaatagtctatcaattagtgagttagcgaaaaatacaaatgtttcaatatcgcaagtaagccgatttgtacgatcgttagggattgaatctttttctgattttaaagaagccttggtatatcacggggagcaaaagcgacatacaggtttacaaagagaaataattgattatagagtatatcagaaaatggttactgaggagattacatatttttatcagaattttgatgaaagtcgagtggataaacttgtctatgatttttacaaatatccaaaaatagcaatttttggaattttaaatagtgataatggagcaaaagaattacagtataatttaattggctggggaaaaatttgcatttcttacactaactttcaagaccaactagattttattaaaagtgcagatagtaatactttaattgtaatttttagcttttctggtaactatgtcatgaaaaatggctattcacgtttttatcatacttatgattatttaaaaagtagtaaagcaaaggtttacgtaattactaaaaataatttagtgcaggagctcgaatatgtcaatgaagttattttggttccaataaaacatgatttatataactatactttgcaatgtcttgttgatttgatttttatgaaatatcaaaaaaatttgataaaatagaatttccattttttggaaataatatttatttaaatataagaatgctatgctaaaggagggtgagtcgaatgaaaataaatgaaaattgtttaccatgcttgatcagtcaagttattaaagtggccaatattacaaatataaaaaatcgtgatatgttttatcgaggagtatttcagtatttgggaaaactaaattttactaaaactaatccagagataattggtgctacatttgaaatgatcaagcagcaagttaatgatgaggatccatattttgaacttcggaaatattataacgaacttttcttatcacgtagtactgaatttgaaaataagatcaactcttttgaaacggctgttaaatatgcaattattggaaatattattgattttagtcctatctataatacccaaattaaagacattgataagtggtttgaaaatattgatcaattaaaattagcaattaatcagcttgaagaaatgataactgatataaaaagtgcaaaggtacttttatatttaggtgataattgtggtgaaatttgtcttgataaattattaattagaagaattaaaaaactcaatccggagattgatatatattttggtgtaagaggaaaaccagtagtaaatgattcaattgaagctgatgcatattttgttggaatggatgaatacgctacaattatcagtaatggtgataattctttgggtacggtattagaacgtacgagtaatgaatttaaaaggatataccgaagtgccgatatagttattgctaaagggcaggcaaactttgaaagtttgagtgaacaagagaaaaatatttattttttattgatggttaaatgtgaagttattgctaattatattggggtcgcacaaaaatcattaatttgtttaaactattataaaagcatgagtcattgattcatgcttttacaacaattcaaaataattttagttgaattaagcatatttttaagctgaattagataaattggtaatatcaattgtaattatagcaatattctttataattatattattagaaaataagtaggatgatataaatgaaaaagatagtattaggaattcttgcacatgttgatgcaggaaaaacaacattaactgagagtatattatatttaacaggaacaacacgaaaattaggtcgagttgatcatcgggatacttttttggattatgattttcaagagagaaatcgagggattacaattttttctaagcaggcaataataaattggcatgatagccaaattactttaattgatacgccaggtcacattgatttttcgacagaaatggaacgtacgctacaagtgctcgattatgctattttggtaatcagtgggatagacggtgtccaaggtcatagtgaaacaatttggaatttattgagatattataaaataccaacctttatttttattaataaaatggatgttagtcgttatgagcaatctgaattaatgcagaatttaaaagaacgactagatgaacattgttttgattttagtaatttgaatgatgaattttatgaaagtgttgctttaaatagcgaagatttattgaattattatctagaatataataccttaaacaaagagatgttaattaatgaaattgctagatgccaattatttccgtgtttttttggctctgcgttaaaaatggaacggattgataatttttttaatgaatttactaattatataaagaataaggattattctgaatcttttggagcgcgagtttttaaaataagtcatgacgaacaaggaaacaaattgacacatttaaaaattactggcggtagtttaaaagtgaaaacgcaacttttaaatgatgaaaaagttgatcaaattcgtatttattctgggaataagtatcatttaactgatgaagtgatggctggggatatttgtgcgattaaagggcttaaaagtatagttgctggtcagggattaggtatagaagataatacgactcagccattgttgtcaccatacatggattatcaaattaaattgcctcctgattgtgatcaacatcaagtgttaaaaaagttaaatttattagcacaagaagatcctcagctacatatcaattataacgttagaaccaaagaaattcatgttcaattaatgggtgaaattcaaattgaggtgcttaaaaatataatccaagagcggtttaaagttgaagttgattttgattatgggagaattatttataaagagacgattgaagaaactgttgaaggggtaggacattttgaaccattacgtcattatgctgaagtacatttacttttagaacccgggaaaccagggtcgggattaaaattcgatacaaattgtcaagaatatcttctagcgaataactatcaacgattaattttgtcgcatttacaagaaaaagagtatttgggagtacttacgggctcgccaatcacagatatgaaaataactttagtggctggaaaagcacatttaaagcatactgaaggcggtgattttagagaggcaacatatcgggcgatacgtcaaggcttgaaaacagcaaaatcggttttactagagccgtattttgatttttcacttgaattaccgattgaatatctgagtcgagcgatttatgatattgaggcaatggcagggaactttaaattaccggaaaatcaaactgatattgtcgttattaccggaagtgcaccagtcagtaaaatgcaaaattatcaaagtgaagttgttagatatactaaaggaaaaggacgcctaatttgtcagttaagtgattatcgcccatgtcaaaatcaggctgaagtaattaaatcattcaactatgatagtgaggcagatgtagaaaatccaacaggatcagtattttgcagtcatggtgctggttataatgtaaggtgggatcaagttgcccaacatatgcacataccatttgtttttaaaaaaataaagaagaccgctaataatattcaggataaatctaaatttgataatattgatgacgagttagaaaatattttcacacgcacttatggaccagttaaacaaagatctggcgaacatcaagtaactaaaaaaatatttaatgagtcaagttataaatacattccagaatgtttattagttgatggctataatgttattcatgcctggccagaattgaaagagttagcaaaagataatttagacgcagctagaatgcgattaattgatattatgtgcaactatcaaggttacaaaaaatgtattttgattttagtatttgatgcatataaggttaaagataatattggttcaactactaaatatcataatatttatatcgcatatactaaagaagcacaaactgctgatatgtatattgagcgggcaactcatgagttggcaagtaaatacaatattacagtggccacatctgatgcgttagaacaattaatcgtattagggcaaggtgggaaaagaatatcttctcgcgaacttcgattagaagtagcacaacttgatcaagaaaaattagaagaattccgacgtaaacaacctaagagtcataattatttattagaaggacttaagaattttaatcaggattaggagtttgaaaatgaaaaaaacatttaaatataatcttaattatattggtggtattgctgaatatcaaaagcgtgctatttataccttaaatcttaaagaaaatagcttttcagttgatggtatcttcaaaagtagaaagttttcttataacgatattattgaagtgaaatatggtgaaatcgaggaattaaaaaaacagctggatcctgtaaatgttttattatttggacgaatggcgttattagatagacgattgaatcgtaaattaaaatattgtttagctattattttaaaagaggaaatgactattgtttttgctgaggaatacgatggtacgattaaaacagcatataatacactaagtaaaatatataaaatgaccggctctaaatagaagccggtttttaattttagtaaataccttgacagactttattaataagattagtatactaatagttaggatgctaataataggaggaaagatggctaattcattatattatttattatttaaaacagcgcatacacaaaggaaaaagaatattccttttttaaaagaactgaatttagcaccaggacagccaaaggttttacgatatttgtatgaacagaaaagagaatgtttacaaaaagatattactaaaggttgtgatattgagcctgctacagtttcaattatgctaaacaaattagaaagtaatggttttattaaacggaattatagtgaggaaaataagagaaatgtatatattcaacttaccgaattaggaaaaatcacttttcttaaatggcaagcatatctagatgagcgtgaagatattaccttgagagattttagcaaggaagaaagaaaacaatttattaattacttagagcgcctttatgacgccttgttaaaggaggaataagatgttcaaacaattttttggctattttaaaaactataaaaaatatctttatttaagtgcagtgtttgttattttagaaactctttttgagttgattattcctttgataatggctgatattattgatatcggtgtagcaaataaagatagaaattatattctgatcaaagggggattaatgattatatgtgcgcttttgtcgcttggtttaggcttattgtatgcaaagactgctgccaaagcaggacaggggtttggctatgaattgcgaaaagcacaatatcaaaagattcaagaattttcgtttaaaaatacagatcattttagtacttcatcgttagttactcgacttacaagtgatgttactattttacaaaacgctatttgtaatgggattcgtccgttagttagagcaccttttatgatgttaactgcactaactatggcaatactaattaatgctaaattagctgttgtttttttaatagctattcctgttctagcaacatgcttaattataattatgtcaaaagttcgtcctttatatgggaaaatgcaaagagctttagactctgtcaattcgatagttcaggaaaatctaattgcgatcagagttgtaaagtcatatgttagaaaagattacgaacaagctaaatttaatgaagttaatttgaattatcaacaagtttcacgtaaatcattccattatgcagttatgaatatgccgtgttttcaatttgtgatgtattcgacgattattgcaattctatggtttgggggtgggatgattcaggttggaaatatgcaagtaggtgaattaacaggatttttaagctatattatgcaaatcttaaattccttaatgatgatttcaaatgttttcttgatgttaactcgttctctagcttcggcatatcggattcaagaagtttttgatgaagaaatagatattaaagatgaaaaaagtgacataaagattacgaggggaaaaatcatatttaaaaatgttgcttttaaatatgacttaaaagcaaaagaatatgtattaaataatataaatttggaaattgagcctggtgaaactgttggtattatcgggggaacaggtagtgccaaaacttcattagtacaattgattcctagattatatgatattacagcaggggatttattaatcgatggtcatgatataaaatcatatggaatcgaacatcttcgagatgaaattgctatggtattacaaaaaaacactctattttctggaacgattaaggaaaatattttatggggtaaagcagatgctagtgatcacgaacttaatgaagttttagacattgcttgtgccagtgaatttatcgatgcattgcctaagggaatcaatacagatttagggcaaggtggagttaatgtttctggtgggcaaaaacaaaggttatgtattgcacgtgcattattaaagaaaccaaaaattttaattcttgacgattctaccagtgcattagatacagcaactgaacgaaaactaacagatggattagcatactatttgcctaagacaactaaaattattatttcacagcgattatcatcacttgcccatacagataaaattgttattttaactgatggtaaaattgatgatataggaacacctgaagaattagcaaatcgtaatcatatctatcaagatttatgtaaaattcaagaaggagataaataatatggctagaataaacggaactccacgccctaaaaatttaaagaaaactttaaaagcaatggctagttatttaactcgacatataggaacactcataatcattgctattttagtattaattagtgcaggtgcaaatattttaggtacttatttattaaaaccggttattaacgattacattctaccaggtaataatgctggactattacaagcaataataacgatggcaattatgtatttaactggtgtcggggcttgtcatctatataatcaattaatggtaaaaactgctcaagaaatcgttaaagaaattcgtgaagatttatttgataagatacaaaacttaccgcttagtttttttgatcagcgtactcatggtgagttgatgagtcgatttactagtgatattgatacaattttagaagctttaaataatagttttgcaatgttgattcaaagttttataatgattgtaggaacaattacgatgattattattttaaatccttatctatcaatcattgtaattgcttcaatggtaatgatgtttatttttattcgttatagtagtaaaaagagtaagcagtattttaatcaacaacaaaaatatatgggaagtttaaatggttttattgaagaaatggtcgaaggaagtaaagtagttaaagttttcaatcatgaacaggtgaactttgccgagtttgaaaaaagaaatcaagctttacgacaagcagctacgaaagcagttacttattcaggaactatgataccaacagttgtcagtatttcatatttgaattatgcattatctgctgtaataggcgggtttatggcaatttatgggattatggatttaggaagtttatcatcatatttggtttttgttcgacaaactgcgatgccagtaaatcaattttcccaacaaatgaattttattttggcagcaatgtcaggtgcagaacgtatttttgaaattatggatgaaaaagttgaaatagatgaaggaagtgtcactttaacaaatgttcgcaatgaatatggtaagctagttgagtgtcatgaaaatactggactttgggcttggcgtcatccccgttctaatggtgatgtagaactggttttgttaaaaggtgatgttcgcttccatgatgtttgttttagttatgtccccaaccatcctattttaaaaaatttaaacttatatgcaaaaccaggtcaaaaaatttcatttgtgggctctacaggagctgggaaaacaactattactaatttgattaatcgtttttatgaattagattctggcagtataacatacgacggaattgatattaaattaataaaaaaagcagcattgcgacaatcgttatcaatggttttgcaagacactcatttatttacaggaacgattgaagataatatacgttacggtaaattagatgctagtgatgaagaagtggtggcagcagctaaactagcaaatgcagattcatttattcggcgacttccgcaaggctatcaaacaatgttaaccggtgatggttctaacttatcacaaggacaacgtcagctattagctatcgctcgtgcagcaattgctaatcccccagttttaattttggatgaggctacaagttctattgatactcatactgaaaaattgattgaaaaagggatggatagtttaatgaaagatcgtaccgtttttgtaattgcacatcgtctttctacagttcgtaattcaaaagcaatcatggtactcgatcatggagaaatcatagaacgtgggaatcatgatgaattaattaatcaaaaaggaagatattatcaattgtatactggaaaaatggagttgtcatagaggatatcaataggtatccttttttgtattgataaagtgtgaagattgtataaatgaccaatttgtgttatcctttaggggataagggaatggagataagcatatgaaaaaagtaagattagttttgatatctttattaatgttttttgctgtaactggatgtagtaatgaggataaaaacttattagacaaggatgatccaacgacgattcaagtatggcattattataatggtgcgcaacaagaggaatttaatcgtctagtcgatgaatttaacaaaacagtcggtaaagaaaaagggataattgttgagggctctggtcaaggaacaatttctgatttagaaagaaatgtcttagattcaattaatggaaaagctggggctgcagatattccgaatatttttgcagcgtatggtgacacagcttatcaagtggataagttaggttatgcagtagatttaaataaatattttagtaaagacgagctatctaagtatgtcgatggttatcttgaagaaggacacttttcaagtaaagatacattaaaaatttttccagtggctaaatcagtagagttatttatgttgaataaaacagattgggagaagtttgcaaatgctacgggtgcttcaacaaatgatttaaatacaattgagggtgttactaaggttgcagagcaatattataactggactgatagtttgacagctgctccaaatgatggaaaagcattttttggtcgtgatgcttttgcaaattatatgctcgttggctatcgtcagctagcaacagatatttttagtaaaaaggataataaaatcgtattaaattttgaagcagatattgctaaaaaattatgggataattattatgttccttacataagtggttattttagttcatcaggtaaatttagaagtgatgatataaaaatcggaaatattcttgcttgtgtttcttcatcttcgagtgtcacatattttcctaaagaagttattttaaatgacgaagaaagccattcaattgaattggagacatttgcttgccctaaatttaaagatggtaaagattatgtcgttcaacaaggagcaggaatggttgttctcaaaagtgaagaaaaagaacaacaggcagctgttgaatttttgaaatggtttactagtgataaacaaaatattgctttttcaaatgctagtggttatttgccagttaccaaaagtgcaaatgatcttgataagattactgatgaagtagaagtcaatgagtcagtaaagaaaacgttaaatactagtcttaaaatgatttcagataataatatgtatacatcagttccttttgaaaagggaactgatgcaagaaatgttttagaaacaacaatgagtaatttagctaaacaagatcgtgaaacagttattactaatctttcaaatggaatgaatttagaacaagcaattagccaatttaataatgatacttattttaatcagtggtatactaatactaaaagccaattagaatcattaattaaatagttctatagaaggaggattgtgatgtttcgtaaaatcatgaaaaacaaatcaattttttcatatttacttgtagtaatgtgtattttagtgttaatcgagacaacaatccttgttggtagcctttcaactggtggaatgtttgctaaattaaaccagaacgctaaagatattgttgatcagcgagttattaatcgaagcagttatcttcaaaatgaaatgttaaacaattggtccaatttatctcaattgacagaccacataaatacgacagctaagcagcttgttagtgaaggaaaggttgattatgagcatcttgatgacagctctgaaacagcaacaccacttattttggcagttgtagatcaattgatttcaacaatgcgctctcagcatgttacaggggcatatatcatttttaataatcatgacttggataagggacttgaagataaacctggaatatatttaagagatcttgatccattatcaaaagcttcagcagaaaatggggatttattaattgaacgagctccaactgaagtggttaaatctttaaatattgctactgattcatcatggcggccacgttttgaatttaaaaaagcaaacataaaatattatgattttttctatactccataccagcaggcaattagtaattcacaagaattttcgagtactgatatgggctattggggtgggagttttcgcctgagagattctgaaaatgaggctttcacctactcattaccgctaatcaacgatcaaggagctgtttatggtgtcgttggaattgatattacattagattatttgaacaaattattgcccagtacagagttacttgatgaaggtaatggaagctatttgttggcaatcaatcaagatgattcattgattttaagtaatattttaactaatggaaatatttatacgacgaaaagtcctacaactgaattaatgcaatctgagaatgattattatatcaatcaaggttctaacactttatatagttcattaaaatatttgaatatttataattctaatacaccatacagtaatcaacgctgggctttagtaggaatagttgatacttcagatttatttgcatttacaaataaaatcacttcgattttgatgttcgcaatctttttaaccttgacagttggaattggtggaagtttcatttttagttatatcatttcaaaaccaataaaaaaattatcagatgaagtcgtaaaagctaatattaaaaataagatttctttcagacgtacaaatattgctgaaattgatcatcttgcaaatatgatggaacaactaaatcaaaatgttcgtgatactgccttgaaattcactaatttattacaaatggcaagtattaagctagcagggttcgaatataatataaacactgaagaattgtttatatcagaaaacttttttgaggttttactaaaatatgatgttaatacttcagaattaacaatgacaaaatttaaagaaacatttgaaggctataaacaatatattgtttcacatgattatagcaaaaaagaatatctcttcaaaattcctgatgatgataattatgtttttgtgaatctacggctattggtaaatgataatgcatatactggggtaattgagaatgtaactaatacaattgttgaaaagaatgtgattgaatatgaacgtgatcatgatgctctaactggacttttgaatcggagagcatttattaggatcatgaatagtttatttgaaaatgaaataaacaaaataaaaatagcagcactattgatgttagatttagataatctgaagtacattaatgataattatgggcatgaaattggtgataattacatttctaaagctgctgaaacatttgtaaacagcaccccagaaaatactattatttcacggatttctggtgatgaattttttgttttcttttatggttatgatgatgaaaatgtaattaagcagttaattaataaattaaaggaagcaattagcaaggcttttattcctttggctgataatagtaattttcatgtcaatgcatcaggcggtattgcctggtatccacgggatagtgaatcttttgaaaaactccaacattatgctgattatgcaatgtataagatcaaacgtacaagtaaaggtaatttaacagagtttaatctcaatgattatattgcggattcttttttaagcgaaagtaaagaagaattaaacactattattgaagatcgagcaattcagttttattttcaaccaattataagtagcaaagatggaactatttatgcatatgaatcattaatgagatcatttatgccatcattaaaaaatccccttgatattttaaaaatagctaaagaggagggacgtttagcagaaattgaagaattaacatggtcctcatcacttgaaacctttgccaaccatttacgaaatgagcgaattaataaagattgtaaaatatttattaattctatttcaaatcaaattttaagtaataaaaaaattgatgagctagaaaaggagtattcaaagtatttaaaaaatgttgttttagaagttactgaagttgagtacattgacgaaaattatcatcagcaaaaagcagaattaatgaaaaaatggcaagcagaattagcattagatgattatggaagtggatataatagtgatcgaatcctattgctgatttcacctaaatttattaaaatcgatatggatataattcgtaatattgatagtgatcctgataagtgtaaaattgttgaaaacattgttaattatgctcatgaacgggatatgaaattaattgctgaaggaattgaaacgattgatgaattaaagcaggtgattaagcttaaagttgattatcttcaaggttttttattagccaagccgcaatatttaccacctcggattcaagaagatgtgattaagttaattcaacttttaaatgaaaaatagatatagaaggtacagtaatgtatctaaatatatctttttgtttagataaatagatttgttttaaatgggagcctgtccaagaaaaacttgaacaggcttattaatgctataaagcttttttactatttagattcttaagataataactaacactccttgtcaggatgattaaaacaggaatgctaataacaatcgtaattaggataatttgaattaacttaggtgttaatacatgcatttctaaaagtggccaaaaaatcggtgtagagaggataaagccaataatatcaattattaaaactccacctcgataccagtttaatggtttataaatacgataaatcatgtgaatagacacaaaagcagttgtaaaatataggactgaaaaagtttctgctaacgacaattgtaaggttggtgcgagtaatcttataccagcaacgcttaaaactattgctaatgcgttaggtaaggaaaaacgcatagcatgatgaccaattgattcttttggtttttcgatatttcgttcaaataaaatcataaatgaagggaaaccttcaataaacatatccaataaagtcatttggaaaggaataaaaggataaggtatattcattaaaatagataatattgaaagtaaaatcgtgtaaattgttttcaagtaatacattgacgcagaacgtgtaacattattaataactaggcgaccttctcgaacaacttctactaatgtttgtaatttaccatcaataataataaattgcgatacttggcgggcaatatcggaaccagaacccatcgcaattgaaacatcagcatcttttaatgctaaaacatcatttactccatcacccgtcatcgcaaccttttgattatgtttttgtaaacataagatcatctggtgcttttgaaaaggactagcacgaccaataacattatagtttaaaattgcatcttctaattgttgatcagtaacgattgttgaagcatcaatgtatttttctgcattagcaacacctgcttgactagcgattgcactaactgtcgctggattatcaccagatataacttttacagcaacatcattatcactgaaaaatttaagggcttcatgagcatctttccgaataggatctttaataacaattagcccaatcggtgttgtttgtcctaaagtttcctgtaagatatttaatgttgggtgatggccaattaataaaacacgtgcgccgcttttttgcatctcaataattcttggtgataattgataatcaggacgaattatttctggtgctccaacaataattgttcctattgaatctagttcaatggcgctccatttccgggctgaagaaaaagctatacggtctaatgtttcatactttgcagggccagtaaaatagttactaagtgttttaaaagtaatattattatcaagagatcctttaacaaaggaacacataatctcatccagatcaagatttaatggattttttaatttaatgacttgttcgatttccatttttccttcagtcaaggtaccggttttatctaaacatagaacatcaattcgtgataaggtttcaatactaaacatttcttgaactaaagtgttcattttccctaatttaacaacactagcagctaaagatacacttgttaatagaactagtcctttaggaagcatccctagcagagctgtagcagtgttgacgattgtgcttgtaattccttgatcacgaatgatataagcctgatagagcattaaaatacttaatggtaaaactaaataactagtataacgagtaactttattaaaagtgtttaataagacagaactaacaggcttacgagttcttgcctgatcagtaattttatttgcatagttatcttttccaacatgttcaaccttaccatagcaagcaccgctcaaaataaaactaccagataataaatggtcaccaggccctttagaaattggatcagcttcaccagttaaaagtgattcatcaacttcaacattattttcaataataattgaatcagcactgatttgattaccggtttcaaaataaactacatcatctagaacgatttcttcgttatcgattgaaatcgtttttccctcacgaataactttagtttttggcgaaacgatcaagtttaatttagcaaccatatttttagattttatttcttgtcgcgctctaataacagtatttgaaatgacaataacaacaaaaaataaacttgaatatgcttgaacagcaattagagcagcagcaataataaaattataggcattaaagaggttaaaaacatgccccataataatttgaaaattacttttaactactggtttaggggaaaggttcactttcccttcactaatacgctttgcaacttcttgtttatttaaacctttaatttttcccataaataacatcctcataaaaaacaaaatttatctaattgtaatataactacaattgctttgcaatgaattagcaagaattaaccaatacataacaattataatcataacacgctattttaaaaattctatcataataaatcctaagaatctcttaataaatcttaaaaataaaaatagttttattgaaataggttccatcttttgaaaaatcaaattctagagccaatttcgaaaactacttttaattattaatatgatgatgaggaacataagaattgtcatctatacttttaaaagaataacctagtgcctgataatgctcgattattgccggaagggcatctaccgtggtatttttggcatctgtatcatgagcaagaatcacttgattattggcatttccagctgtagcagtagcaatgatttgattaactggaatattgtttccaccggcatcacctgtactataattccaatcataaaattgataaccacggtcaattacttcgtttgctagaatactcatgattccaggacaatatttacgtgaaattgtatttgaagctccaccagggaaacgaatatactttggaataaagccaatttcatttttaaccatgtttccaactctttctaaatcattaaaatatgcggttactgaagtataaacggttttataatcatggctgtaagtatgtaaaccgattgtatgacctcgttgatatgcttctttgatcaagtaattatagttttggtttgtaccagtcacaaagaaagttgcttttgcatgatatttgtcaagaatatctaaaatacgtttggtattttttgaaggaccatcatcaaatgtcaaataaataactttttcttcagtttgagcataaactccaatttctttcttttcaacaactgaaacttttcttttagcaactattttattgccagacctatctttgcaagtataggttacaatataatcacctaatttatccaatcttacttttttgttatcaatagtcaattgtggatgtggatcacgattatcatttcctttaacgccagctaaataatcaaccttaccatttaaagtgacagttagatcattaagaccagaaatagttggttttgttgtatctttagataaaactgtaacagtagcgtgctttgttgatttattattactttcatcgctaacaattactgtcactttgacttttcctttttttgaaaaattatatgcatctttaaaagaaatagttgtttttgtttcatcaacaatgttatcaactaacattgttggatcaacatccattcctgcatctatttcaatattattaatttcaaatttaggcttagttttatcaactacgttaatatttactgtgaactttttgccctgataaatataggtaacaggatagctgccaattttatcattttttaatttagatgtgtcgaccttaatatcggatgtttggacatttttaatatttttaattattttttgataatcaaactcatggttgatttctagtattgggtctttgacaaaagttaacaattggttatttttttaccagattaaataaactgtactaataattaaaataaataatactgaaataaaggtaattttttgtttttttgaaaatttattgaataacttcatttttctcgacctttccataaacattataggtttcaaaaatttattgtcaataaatgtcatgaagttgtataattttttttaaatatggtataatgccaaaaaaggaaagggggaacaaaaatgtccaatatatatgattatttaaaatggcgaggtgatctgtcaatgagaatagatccatttaatgatattgatggcttgattttaagtgaattagtttatgttgattttgataaaatagttcccacatttcccaatgaacaaagttattgtttaaaagatgttgctaataattttagtcaagtaaataatattgaagaattactagatgagatatctttcactaaggaatcaattacattattacaagaattagctaaatgtccgcgttatcaaaatattctgctatctaattatattaatgaactggactatcaaagtataaaacaatttgcggcaattacttttcaattagaagatagtagtatttatgttgcttttcgtggcactgatgatacaattttaggctggcgtgaggattttcaaatgacttatcaatttccagttgcttctcagcaaagagcagttgagtatttggctaaaattgctgaaatcgatttttctaaatcacttttttatcttttatgccattgtgattataaaatgaagtggtatcaaatttttaggatatatatcacccaaaagatatctggtgttaaaattcgtgttggtggtcattcaaaaggaggaaatttagcagtttatgcatctagttgtgtgaattctaaaatatctaaacgaattattgagatttataataatgacggccctggttttaatcaaaaaatgctaaatacagataattaccgcaatatttctactaggataaaaaaattcattccagaaagttccgtattcgggataatgcttgagaatcttgaagaaaaaatagtagttaaaagtagcgctaaaggtttaatgcaacatagtggctttagctggtcagtagaaggaacacaatttgtttgtgctactgaaatgagtaaggacagccaaactatggatgcagcttttaaatcatggctaagtaaagtcgacagtaaaacacgaaaggatgcagttactgcagtattttcaattttagaagcagctaaaattgaaaaaattaatgatttttctgaaaaatcattatcacatctaattacggctattaaagaaatcaaaaatatgaacagcgatacaagaaatgcattaattcaattttttaaaacgttaattgtagagacatacgattgtagtcgtaaagaacataagaaaaaagatactaatgaaaataattcataaagatttaataatttcaaattatacttaatgtataatttgaaaagagggttaacatgaataagtttcaaaatgcgctgtatcgctttatgtcaggtcgttatggattggatcaactaaacaattttttattaatatttgcattaattttattaattttaaatctttttgtaattcgcaatccatatcttgcaacaattatttggataattttaattattaatatttttaggacctattctcgtaatatttataaaaggcgagctgaaaatgataaatttttatctttaatccagcctgtcaaaaaaagaattaatattattaaaagtaataaaaatgataaaatgcataaatattttctatgtcctaactgcaagcaaactgttagagtgccacgtggtcggggacaaattacaattacttgtcctaaatgtaaacaaaaatttgataaaaaaagttaaaaggaggaaactattttgtttcttcctttattcgttttaaatgtttaataattatgtgtgctaatttttctagctcttcctggtcatcaggttgaaaccgtgcaaaacaacgagaatctaaatctagaacgccatacaagctattatctataatcaacgggataacaagttcactgtttgttgcgctatcacaagcaatatgactaggaaactgatgaacatcaggaacacagtaagttttaagatttgttgcacaggcaccgcatacacctttgttaaaggggatgagtgtacaagctgtttttccttggaatggacctaagatcagctgattatcttggcaaaggtaaaaaccaacccaagatatatcagaaaagacttgtttgataaaggcacttgcattggataataaacttatttcataattaatattttctagtaatgcatctaattgttgttctttcataaaaatcaccaaattcattatacatgatttttatgatattttgtttaaaaaaaataattttggtgaaaaatatagatagataagttaaaggagaatagatatgaaacgtattttaaaatcaatatgctgtttattgttattatttgcaatgagtttttcgattgttggatgttcaaacaatgatgatactaacaaagatagtaataacaatactaccactaatgaatcagatgaggataatggattagagggaattgatagtagagttaaaaataaatttagtagtgactataaagttaatcgtgatgatgtaaatgaagcagtaaattatattcgcgataatatcgatgatgttaaagacaaagaggttgcgaaaaagctttacgaacatggtagttatttagaaatggctgcagataagggagaagttgacgatgataattcaattagagatttagggatcagcacaaaagaatacgctgcaaaagtttataatgctaaagatggagaagttgatgacattatagctgatgctaaagttcgatttgatcaatttaaaaccgatcttgatagtggtgtggatactgcagttgataaatttatggatttctttaaataagggcacaaattgtgctcttttttaatttaaaaagtgatagaatcttgattctatcacaaatattaatcttgatttaataaatagtaggcaatgctactatagacagttgttcctgttaacaaaacatcttcattaaagtcatatgtacagttatgaggtgaagcgactagatcagttgtcaatttcatataagtgcctattccgccatgtgcttggacagtggcaatcatataggaaaaatcatcactaccgtctagcgggcttaaatcctctttggcaactttaatatcacctaaatgatcgatacaaatatggcgaattaaatccatcatttttttatcacagtcaagcgaataagcttttcccatctcgtttatctctacaatggtatcgtgcattaatgctgctcctctaataacatcccgagcataaacttccatataattattcaattctgtagtggcgccacgtacttcgatttctaatttagctgtttctgggactacatttcttcctgttcctgctctaattgtaccaacattgatacgggtacaaccatcactattacgtggaattgaatgaagatttaggatacatgaagcagcagataataaggcgtttttgccgaattgtggcattcctgcagcatgagaagaaacaccatgataggttacgtcaagttttgttgttgcaaatgtttcgttcattcccaaataaatatcataatcttccccttcgacctgctgccaaatatgacccgcaaaaatataatcaacgtcatcaagaattccgcttaaagcaatacttttagcgccacgtacaccttcttcagcaggctgaaaaattaatttgattgttccatgtagttgttcctttatttgtgctagtattttggccacagttaatcccatggcagtatgaccgtcatgaccacaagcatgcatagcaccaggattacaagaaataaagccatttttaccaggattatgatctgctgaatcatcttcagtaatgctaagagcatctatatcaaaacgaattgctacaacaggtccaattccgttgtgcattactccaacgaccccggtaaaaccattctttactttttctatgtaataggggtcggctccttgaaggagggcacgattgtaatttaaagttaataggcgtttacttggtaatcccatccggaactcttcacgcataacttccttgccaactgagacttggtaccctaaactatcaagtctacgggctactagtgaagcagttcgcatttctaaccagccgcgctcagcatatttatgaaaatcacgtcgagtttgaattgtttcttggtggtattgttgtgccaataattttattttattatacataatataccttcttcctttattctattctatcaatatttatgttattttggcaacaataaaggctaaggaaaatccttaaccttttgacaatctcttttttcgacgtttttcaagaaattatttaaatatttttatatatttaaatagttcagcagacaagtcaacaataattgatgaaaacgcaattaatcctaatagtatcattagccagttaaatgaaacgcctgttaattctaaaattgactgcccgatcatcattgaaatatagtaacaaaattgagttgaataaataataaacttgcgatatttagttagtggtctatatatctttaaaagagctattgtataattccatcctgtaaataaaacacagacagttgaaagcatgttaggatcataattcaaagcaagaccaatatttgtaattaaagtagctcctatggcaattgtaaaagcagaagggaaagacttttctaaaacggtttctaaaaaatttccttcaactcgtgcaaagttagcttcatatgtcaagaagaaagttggtattcctacaccacatgcgctgataagtgataattgtattggctcaaaagggtaggcttgaccaaaaaagatagttgaaatagctatgagagcagaaaatatagttttaatcaaaaacatagatgctgacatcgtaatattattaataacgcgccgtccttcatcaacgatatgaggcattgcatcaaaattgttatcaagcaaaactagattagctgcatttttagctgcatcacttcctgatgccattgcaatagagcaatctgcctctttaaaagctagaacatcattgactccatctccagtcattgcaacagtgtgaccctgttgttttaaggcaacgaccatagcctttttttgttgcagagtgactctcccaaagaccgaatatttatttaaagcttctgctatttcttcagaagttgaaagggtagttgcatcaacataatggtgggcattattcaatccagctcgtttcgcgatagatgaaactgtaatcggatcatcaccagaaataacctttaaatcaacaccttgctcgttaaaataagctaatgtttctttagcgtctttcctaattacatcacttaacacaataatacctaaaggctctaaatcgacaggcaaagcttcattactcattacttcatcagtatgtgccaaaactaaaatacgatagccttcactagcatagtcaacacatttttcttccaattcttcatttccctttggaaataaaaactgataagctccaatataatatgtaccacgattaaaataggaggtaccactatattttcgatcagaactaaaagggataacaaaatatggattaaaattagtttttgtttgataatgctcttttaatgcttgagcagtgacattaacatctgttagagaatgcattaagtttccaacgatttcactaatatcaacattgctcattttaacatcaaattcaactttcattgttccttcagtaatagtcccggttttatctaagcataagacatcaacacgtgccaaagtttcaatgcaaaataattcctgaactaaagtattctgttttgctaatcgtaaaacacttaaggtcaaagcaacacttgtaagcagcactaaaccttctggaatcattcctagtatagcagcaacggtactaacgattgagctgttaaatgtttgatttccataaaaaaattgctttaaaaataatagaccgccaatcggtaaaataacgatgcttacatattttaaaattttatttaaacaacgatttaattcagaattatgtttctttaaacgttttgcttcctgtgtaatctgattcatatagttatcatccccaacgtgaataactttacaaattcctttaccagaggtaataaagctaccggaatacaaagtatcgccattttgttttaaaacaggatctgattcaccagtgagcagtgattcattagtctccatatgcccatcaattaaaatactatcagttggaatctgggctcctgtagttaagacaatataatcatccagaacgatctgatcaatatcaatttcttttaattcatcatcacgaataacttcaacgtgtgaggtagtaagaatagataggcgatctaacgttcttttcgctttaatctcttgatatattccagcgatcgtattaataataattactaaaataaatagtgtatttttatatgaaccaacaaaaagtactaagccgagtaaagcagcatttaaaatattaaaaaaagtaattgtattatttaaaaaaatctgtttataagatttagtgattttattatcgaccgtgttgattttaccattacttatacgctgattaacttcagcggttgataaaccatgataatcttgattatttattttcatataattctcctctttagaatattttaacttaattataatgattaaacaataagttaaaattaatcatctcattaattttacttaagaatatattaaatgattctaaagttaattggacaacttgttattgtatacaatttgtcacaaagattgtatacaatcaaaagaagaagtgttataataaaactacttaaatttatgggggtgcttatatgagtcaatttattgatggttttattgaaaaagcaaaagaaagtaataacaagatagataatgaattatattcaaaatttgatgtaaaaaaaggattacggaacgaggatggtactggggtattagtaggtttaaccaagattgctgatgttgtagggtataaaaaaattgatggtaagaaagttgactgtgatggggagctttattatcgtggaatcgcagtatcagacattatcaataaacgcgaaccgcatcaacgctttttatttgaagagacttgttttctgatcttgtttggctatttgccaaacaaagaggaattagaaaattttaaaaaggagctatctgagcgttatgaattaccaccgcattatttggaatctaaaattcttgggtttccatctaaaaatttaatgaataaattacaacaggaagttttgatgttatattcgtatgacgaggatccagataatattagtccttcatcaacaatgtacaaaggattgaatctaattgctaaaattccttcaattgtttgttatgcatatcgtagtaaagtgcattattttgacaaagaaagtttatatattcaccaaattaggccagatctatcaattgcagagaatatcttatatttattgcgtgaccataaacacttcacacctaaagaagctgaagtactcgatatgtgcttagttctgcatgctgatcatggtggtggtaataattcaacgtttactaatgttgtaataagttcgaccggaacagatatttattcgagttttgctggggcaattggttctttaaaaggtcctaagcatggtggggcaaatcttgctgtaatgaatcaaatgaaactgataattaatgaaattggtctagatgcaagtgatgaacaaattaatgagatcgtcgaaagaattttagataaacaatacaatgataatagtggattgatttatgggattggtcatgctgtatacacggttagtgatccgcgttgtgttattttaagacaacaatgtagcgaactagctcttgaaaaggggcgagaagcagaatttgatttctattatcgttttgaacaggctgctattcaggcaataaaaaatcgtaaaggaattactgtttgtgcgaatgtcgacttttatagcggactaatatatgatatgttgtgtattccaacagaactatatacattgatgttcgtagttggtcgagcagttggatggttagctcataatattgaaaataaattatattcaggacggattattcgtcccgctgctaaatatgttggagaaacatatgaatatatacctatgaataaacgaaaataagaacatatcgatgttcttatttttatatttataagaaaaaactggagtgtctccagttttatttgatgtgacgaacccaaccatatttatcttctaaacgaccccactggatcccggttaaagtatcatataatttttgtgtcaagtcaccagttttaaaatcattgataataacttcttcacctttataataaagttgaccgacaggggaaattacagctgctgttccagttccaaatgcctctgtcaatttaccattgcgaccagctgccattaattcatcgatacttaattcacgttcttcgacttcatatccccaatctttaagaatatggatgatagaatcacgagtaactcctggtaatactgaaccttctaaaggtgctgtaacaactttaccatcaattacaaacattacattcattgttcctacttcttcgacatatttgcgatgtacaccatcaagccaaagaacttgagtataaccatgagattctgcttttacttgagctgcaatactggcagcgtaattaccaccacatttagtgaatccagtgccacctttaacggctcttacatattcatcttcaacccaaatttttacaggatttacaccttcaggatagtaattaccaactggtgataaaatgataataaaagtataagttttagcaggatgtaccccaacaccagcttcacttgcaaacatgaatggacgaatatataaagaagtatcttttgcagttggaatccaatcctgttcatatttaacaattgcttcaaccgcttctacaaacatttcttcaggtaattcagccatgcaaatacgtctatttgaattaatcattcttcgagcattcatttctggtctgaataaagttatgttaccgttaggatcacgatatgcttttaaaccttcgaaagtctcttgggcatagtgaagtaccattgtagcaggatccattggaattggtgcgtatggaacgatgcgtgcatcatgccatcctgttccttctgtatagtccatcataaacatatgatcagtaaaataatttccaaaacctaaattatcttgatttggtttttcttttagagttttcgctctttcaattttgatttccattattaaacaacccccttaatttatttataagtatactctcatttagctagtgatacaagatagaatttatctaataaactatgataatgtaactaattatgttcttatcctaaaaaaagcaattagtttgttggaaacgaagattatatgataagatatatagtagtataaatatttgcagaagttaaaattctaaggccattaatagttatgaatagtaaattataaaggaaggaatagttatgttgaaaatattaatatgttgtggcggaggattctcttctagttatgtaactgagagaatgaaaaaagaagtagttgagaaaggattacaagaagaggtttatcttgaattttatccgttttctcttgttaaagaaaaagaagctgattttgacataattatgtgctgccctcacttaaaaatttatgttgaacgtcttttacaggagacgaccatatcagttccaatttatctgttaccgcctaaaatgtacggttttatgcaattagaagaaatagttgcagatgcaaaagatataattgaaatttatcggacgttccctaataatccagttcattttcctggtgaagagaaattattacggattactcgtggtgttgcatatcgaaatgttaataaaaaaagatagctgttttaaatcttcaatacagctatctttttttattaataattttcatatgtaaattttccataatatcaattgatttctgttcaagaagggggtcgttgcttgcaattcctaaacaatcaataatgatagatgcttcgggtaaggccgctttaataattattgcattagatattacacagatatttgaaacgacaccgactaaagtaatttcattgtattgtttattttttaaataattacctaatgctaatgagccaaaagtttcttttattatttttttatcattttttgctaaatcatggatttttccatataattgccatccttcagtgttttcaagacaatgcgcaacaggaagattttttccttcttgggtagttaaataatttttttgatgagtgtcataagtaaaaataacatcatcgttgttattatggtattccttgataagatctgcaagatagtcttccaaggccactgcttcctggaatcctaaactaccatttacaaaatcattttgataatcaatcactactagtaattttttcatgtgaatcctccatactttttaaaatattttatcattattgattgacaatgtaaatatatggatatataatcatattgtcatatgaataaatattcatacgaaaggagataagaaatggataaagtagtaaacgaagctattgttaataaagttgctgcagcattgccggaagaggaaattctttatgatgttgctgagttgtttaaagtttttggtgattcaactagaatcagaattatttgtgctttgtttgaatcagaaatgtgtgtatatgatttagcggcgtgtttagatatgacacagtctgctatttcacaccaattaagaattttaaagcaagcaaacctagttaaatttaggagagatgggaaattgatgtattattcacttgatgatgaacacgttaagcagatatttgacgctgggtataaacatgtaattgagtaaggagagggtatttatgaaacttaagtatagtttgaaaggtttagattgtgctaattgtgctcaaaaggttcaagagcgagttagtaaacttgaaaatgttagagagtgcagtgttgtgttcgcaacgacaaaaatgtttgttgaaacagatactgatttgtttgatgaatcaaaaattgttgaagctgttaaaagcgttgaaccggatgtagaagtaatcaatttatcaaaaaatggtcaagattataatgtttctaataatcacgaagaatgtaacggtgaacatgatcacaaacatcatcatgatcacgagaaatgtggctgcggacacgagcatgaacatcaccatgatcacaaggaatgcagctgtggacatgaccatgagcataatattgaatcagttcaacatggtgatttaaaaggtgcgattaatattaaaatcagtggattggattgtgcaaattgcgctatgaaagttgaacaagcaattaataaaatgaatgaaatcgatgaagcaatgattattttttctactgaaacactgaaagtaaaacctaagacatcgattgctcaaaatgaattattgaaaaaactacaaaaagtagttgatcaagttgaagacgatgtgactttgacattaaaagatgaaattaaagtagttgaaaaaccaaaattatttgttcctaaggaacatcttgggttaattggtggaaccttagtttatattgctggtattatagcgggcgagtttgattatgcagcaattgtttatggaattgcatatttattagtagggtataaagttatattaaaagcattaaagaatatcaggcgtggtgaggtttttgatgaaaatttcttaatgtgtattgcaacgattggggcattttgtatcagtgactataaagaagctattgcagttatgttattctattctgttggagaaatttttcaagcatatgcagttaataaaacaagaacttcaattagttcattaatggatttaaaaagtgattatgctaatttattagtgggtgaggaaataaaaaaagttgctccagaagaaattaagattggtgacgagattattgttaaagttggtgaaaaggtacctcttgatggagttgtacttgaaggtgctagtactctagatacatctagtttaactggtgaaacactgccgcgtaatgttagcaaaggtgacgaagtattagcaggcgtagttaatttaacaggaattattaatcttaaagtatctcaggtttatgaagattcaactgtttcaagaattttagatttagttgaaaatgcagctagtaaaaaagctccaattgaacaatttattacacgctttgcaagaatctatacgccaactgttgtatttttggctgttgcacttgcaattgttccaatgctgatttttaaagatgcagtatttacagattggttatatcgggctttaactttcttagttgtctcatgtccatgtgcattggttatttcaattccattgggactatatgcaggattagggaaagcaagtaaagttggggcattaatcaaaggcggtaattatcttgaattattaaaggatattgatactgttgtgtttgataaaactggaacacttacagaaggtagctttgaagttgtagaaattaatggtgccgatgacttattgatgcttggagcatatggtgaaagtatgtcaaatcatccaattgctaaaagtattttaagaaaatatggtcaagaaattgatcaaaagcgaattagtgactttaaagagatagcaggtaaaggtattgaagttaaaattgatggtaaagtatataatttaggtaataaatcttatattgaaggtttaggaattacagtcaataatccatctacagtagggacagtagtgcatattgtttgtcaaggtaaatatttaggtaatattgttgtcgcagataaaataaaagaaactactattgaaggaatcaaacatctgaaaaaatatggtattaaaaatactgtaatgttgacaggggatcgtagcgaagtagccgaagatattgctaaaaaaattggaattgacacagtttatagtgagttgttgccacaagataaagtaattcaagtagaaactctaatcaatcagggagcaaaattatcatttgtcggtgatggtattaatgatgcaccagttctagctcgagctgatttaggaattgctatgggtggtgttggaagtgatgccgctattgaagcagctgatattgtattgatgaatgatgatattgttacgattggtgaagcaatcagtatttcacaaaaaacaaataaaattctaaaacaaaatgtgacttttacattgattattaaaattggagtcttattattaacaatgtttggatacgccaatatgtggatgggtgtgtttgctgatgttggagtaacattgattgcaatcttaaattcaatgagaatattacgataattgattaggactggttagccggtcctaattttctttaatttaaagttagagtctataaactttatttgatatggtgtataatttagcgcggaggatatttatggagaaggtaattatattaggaacaggaaatgcaggtgtaaaaaattgttataatacttgctttgctttgaaaaataaaaatgaatatttattggttgatgccggcggtggaaatggtattttaaagcagcttgaactggcaaagattgaattatcccaaataacaaatatgattgttacgcatagccacactgatcatgtattgggagtagtatggatttttagaatggttgcaaccaaaatcaaaagtggtgaatatgacggtaacttcaacatatactgtcatgatgaattggtttctacaataaaaacaattatcaaactaacagtacaagagaaactctataatttaattgatgagcgcatatttattaatgaagtacaagatggacaaaaaatcacaatttgtgaacatcttgtgactttctttgatatttactcaacaaaagcaaaacaatttggtttttcgattgaattagatgatggaaaattgacatgtttaggtgatgagccattcaatgaattatgttatcaatatgctgttgattcaaaatggttattaagtgaagctttttgtttatatcaagaacgtgatttttttaagccatacgaaaagcatcattcaacagtaagagaagctagcgaactagcacaaacattaaatatcaagaatttgattttatatcatactgaggaaaaaaatcttagtcatcgtaaaaaattgtacactgatgaagcaaagcaatattttaatggaaatatctttgtgcctgatgatctggaagaatataggttgtaggaggagtaacatgacactagataaattaattccaggaatgagtgggaaagttacgattgttcacggagagggcttattgcgtcgtcgtttgttggaaatgggattgactccaaaaacagttgtaaaagttcgcaagattgcaccgatgggtgatcctattgaactttatttacgaagttatgttttaacgattcgtaaagatgatgcagcgatgattgaagtagaggtgattagtgatgccaactaaaacaatagctttaattggaaatcagaattgtggtaaaacaactctttttaatgctttaactggttcgaatcagcatgttggtaattttccaggtgtaacagttgaacaaaaatctggaactattaaaaaacatccatcgattaaattagttgatttgccaggaatatattcattaacaccatatacaatggaagaaatcgtctcaactgattttttgattaaagaaaaaccatcaatgataataaatattatcgatgcgactagtattgaacggaatttgtatttaacaatgcagcttttagaattaaatattccaatgattttggcgctgaatatgatggatgaggttattagtagtggtaatagcattgatgtagaaggattacaacaggcgttaggaatacgggttattccgttatcagcaagtaaaaatgagggaattgaagaattgatcgaggctattgaaacaactctaaaagaaaataactgttcacatttagatctttgttcaggtgagattcacaaagcgatacattcaataacccatttgattgaagataatgcagttaaggcaaaactaccaaaacgttttgccgttacaaaaattattgagggtgataaagatattatcaggcaattacatcttgatgttcagcaacttcatattattaaacatattattgaggatatggaagaaaaggaaggcttggataaagatgcggccttagtggatatgcgctatcaagtaattgaaaatatcacacgacaaactgtttttaaagagcaagaaactgcgggtcaagtacgttctgaaaaaatagattctattttaactcataaatattttggaataccaatcttcattgtcgttatgctaatgattttctttctgacctttaatgttattggtgcaccgttacagtcattaatggaaatagcagttgattttatcgggagtacgattattacatttttaactaatcatcaagttgcaccttggctaatttcgctactgcgagatggagtaattgctggagttggaagtgttttatcattcttgccgttaattgttgtattattcttttttctatcgatgttagaggatagcggatatatggcacgggtagcttttgtaatggataagctgttaagaaaaataggtttatctggtaaatcttttgttccgatgttaattggatttgggtgttctgtacctgcaattatggcttcacgaacattatcgtctcaacgtgatcgtaaaatgacaattattgtgacaccatttatgtcatgcagtgctaaattgccaatatatgggatgataattgcagctttttttagtacgaaagcaccactggtgatgattactatatattgtattggaattttagttgcaattttttctgcattattattaaaagcgacaattttccctggtgatccaattccttttgtaatggaattaccaagttaccgaatcccaacagctaaaaatgtgattatgcatatgtgggagaaagcaaaggattttttaaaaaaagcttttacaattatttttattgcatctttattaatttggtttttacaaagctttaattttcgttttgaaatggtcactgatagttcaaaaagtattttagcttacatcggaaataaactatcatttatttttgcacctttaggattttctgattggcgcttatcgacatctttgattactggaataacagcaaaagaatcggttgtctcaaccttatctgtccttactaattcaagtagcccggatgctttatatcatgctttgaatactttacttacaccagcaagtgcatttgcttttttaacctttacggtattatatatgccttgtgtggctgcttttgcggcaacaaaacgagaacttggttcttggctacaggcaatcttgacagcaggttatcaaacaggaattgcttacgtagttgcttttattgtttatcatttagctttattgatttcttgattgacaaataatataattataaatagataaccaatgaaaggacttacattatggataaaaatttaggaactattattaaaattaaacaagatgggatgatcaaagcgtttgaacaaaataatatgcaaattacttttgttgataactttgaacaattacataattatttaaaaaaatatttatgtaatcacaaaacagttgccttaggtggttcgatgactttatttgaaacaggagtaattgatttaattcatcaatctgatgttttattgcatgatcgctatcaagagggattagagcgagaacaaatgcaggaaatattcagaaaagcttttactagcgatttatttataacgagcacaaatgctctaactacaaatggatgtttatacaatgttgatggaaatggaaatcgtgttgcagctatgatctatggtccaaaagaagttattgtaatcgctgggaaaaataagatttttgatagtgaagaagaagcaatcaatcacattaaatcaattagtgctcccgcaaatgctgttcgtttaaataaaaaaacaccatgtactaaaacagggacatgtatgaattgtttatcagcagatagaatatgcagcagctatgtcaaattggggtatcaaggtaacattaatcgaattaagatcgttattgttgatcaagatttaggttattaagatgaagagtggaattttatttcctttatcaagttttccttcaaaacatgggattggtgatttaggaaaagaagcttataaggtcattgaccagcttgctgcaaataaaggtcaatatcttcaaattttgccatttcatccttctactcaagctaattcaccatatcgtgcggtaagtacatatgccggagatgaaatctatattaatttaaacagtttagtcgaaaatgggctgttagatgaagtacctgaatattattctgaaacatcaaatgttgattacgacaaaatcagaaaatttaagcataaatatttattattggcatataacaattttaagggcaatgatcagtacgatcgttttttaactaaatgcccttgggtttttgattatgctctctactgtacgtttgcttcaattaataaaagttatgattgggcatcatggccgactgaatttaaagattatcctaaatatcatcaggtaaatttaacaaaatatacagagcagattgcttactatcaatttgttcaatttattttttatcatcaatggttttcatttaaaaaatatgctaatgataaaggaatcaaaattattggtgatatgccattttatgttgatcacggttcagtcgaagtatggttggataatcagtcatttttattggacgaagcgggttatccaacaagtgttgctggtgttccacccgattattttagtccaactgggcaatattggggaaatcctctttatgattggaaatatctaaaatttaataaatttaaattttggactgatcgaattggctgggctagtaagatcttcgatattactcgtattgaccactttcgagcatttgattcgtattgggatattcctgttgatgcaccaacagcgattgaaggaagttggaaatatgctcccggctacgaactatttgatcaattatatgcctctctaggaagtattgatttagtagcagaagatctaggttatctgcgtcctgaagttattgaattaaaaaatcattatcatctcaaaggaatgaaagtttttcaatttatgttagatgatggttttaatgatcttgaacattcatatttttatcccggaactcatgataacgaaacaatcaaaggatggagcgatagccttaatgaagaagcattgaataaaataaagaaaatagttgatgaaaaactgccgctaaatttagcaattattaaattctgcttacattccaatgccagtgatgtaattgttccagtttgggatttgctggaagtagataatgaacaacggtttaatattccgggagaagttaatgataccaattggacttatcgtgtatcaaacatgagtttagttgagaaagcttttaaattatttaataaactaaaaagtgaggattaaaatgagttataaaaaaatagatgtcaatgaattaagtttaaatccgtttaaaacaatcggaaaagattggcttttaattagtgctgtcaaagatggaaaaataaatacaatgactgcctcttggggtagcgttggagtgatctggaataaaaatgttgtgactgtgtatattagaccacagcgatatactaaggaatttgtagatagtgcagattatttcacgttaactttttttgatggctataaaaaagaattaggggttctaggttcaaaatctggacgtgacagtgataaaataagagaagttggttttaatgttgagatgattaatgaacagcctttattcaaacaaggcacaatgggaatggtttgtaaaaaattatatcggggtaaaattgaaccaacagggttcattgatgtttctctagatgtgaaaaattatccagatcatgattatcattatatttatattggtgaaatagaaagtatttatgtaaacgaaaaagattaatctttttcgtttatttttgcatattaaggacatactttaattggtgagaatatgcagatattagaatatatagttgtccctgttatatcattagcagttctatttggaataacaaaaatgatgggatatcgacaagttagccaattaaatatgtatgattatataaatggaattacaattgggagtattgccagtgagctagtcatgggtgggtttgataatatgttaaagccgcttattgctatgatcgtatatacaattgtaataattatcctttccaaactagcaagtacttctttaacgatgagaaatattattgacgggcatccggtggttttatttgaaaatgatcaaatatataatgaagaattggaaaaggctaaacttgatgttgatgaatttttaatgcaatgtcgaatagggggctactttgatttaaatgaattacagatggttgtattagaaacaaatggaagcttaagtttttttccaaaagaaaaatatcgtcctactgtggtcaatgatttaaatattaaaattaataaagttaatccgccgactttattagttaaagaaggaacgatttttcatgaaaatttaaaatcaattaatcatgatgttgattggcttgagcgggaactaaatgttttaggagtaccgttatcagatattattttaatgtatcaagaggataatagtaatctagttgtatacactattaatgaaattgaaaaaaaatttaattaatgcgtgagttgaaatttagacaacaaataggaagtattattacttcctatttgttattttttcgatatttatcataaatgattttcaaacctttaaaggttaaatcagggtcgtatatatcaattaaatcggtttcattaaaaataatccgacctagtccaccagtagaaataactttaagtttctcattatactcggctttaatttcacgaataatattttcagttaatccaatatatccatagattattccagcttgcatactagatacagtatttttggcgattacacttttaggttttttgatttcaatttctggtaattttgctgcctgactagatagcgcattaatactaatgccaatcccgggagctgttgcaccgcctaaaaaatcaccatctttacttattacatcaaaagtagtcgcagttccaaaatcgattacaaggcaagggccaccgtgaatgtaatatgctccagcagcatcaaccaggcgatcggctcctaattctttaggattatcgattttaattcggattcctgttttaatgccaggaccaacaataatcggctctttattaaaatattttttaatcgaattagtaaatgaatacataattttaggtacaactgaggcaataataatgtcttcaatttcatcaactaatatgctagatgcctgcaagaaacttagcagcataaatccatattcatcagaagtccgttctaattttgttgttagacgataattgtcaataatttcatctttatcaactaatcccatcgtaatatttgtatttccaatatcaattacaattaacatgaatgactctccttgatttttattaatttttttaagattaaatcacttaattcatctttagacataagttcaattgattgtacgtcatttttactaataaaagtgactttattagtatcttttttgaaaccagcaccattttcatttaaattattagcaactaataaatcacaatttttacgtttgaatttatccttagcattttcaattagattttgtgtttccattgcaaaaccgcaaattgtttgagttgttttatgagcgcctaaataagtaagaatatcatcatttttaaccatctccaaaattaatgaatcttcatgcttttttattttattagtagcaatttctttgacccgataatcacctacagcagcggctttaatgatataatcttgtttttcataactttctttgacggcttcaaacatagcacgggcagatttaatattgattacttcaactccatacggaacccttaaatctgtcggaccactaatcagagttactttagcacctaattgataggcgcgttttgccaatgcataacccatttttccgcttgaatgattagtgatgtaacgaactggatcaatcgcttcttgagttggaccggcagttactaaaacacgtttatgttttaatggcttaggacttaaacaatattcaaccatgttaataatatcatcagtatcagctaattttccacggccaacatctccgcaagcaagtaacccgtagccaggctcaacaaatttaatgccataagttttgcatctttcaatattacgttgcgttgctaaattgtcatacatattaacattcattgctggtgcaatcagcttaggacaagtagcagctaaaaaggttgaagtaacaatatcatcgcaaacaccattagcaattttaccaataatattagctgttgcagggacaatgataaaacagtctgccttctttgcatagctgatatgtttaatttgataaccttgatcgtcaaagtcatcgaccagaacaggtttgttgattaaagcaccaagagttaggggactgataaattttgttgcattttcagtcataattacttcaatatcataatttaatttttttaaagctcgaactaaatcacaagtcttataagcagcaacactgccactaatacctacaataattgttttcatattacttcctttctatctttgaactatctcaaatttgattaataatttaaaaacaattctagtatcaatcatgcttcatcaccatcttttattcattgggaatgagcttggattaaatactagaatatataataattaacttttctatatttcattttgcctccactaccgttcttcctagatacagtgtcaatcatgatttataaatgattaatgatgagcgatcatcactaaatgataaagccattatattacttaatgaataataattcaatcatttaaattgtaccttttgtctgattggtgctaaaataataaaaaaagaaatggagtgagttgaatgaaaaaagtcgcagtattatttcatgatggatttgaagaagttgaagctttaagtgttgtagatattatgcgtcgagcaaatgtagaatgcacaatggtaggaatggataaattagaagtcactagctctcatcaaattaaaattaaaatggaccaaatctatgatgggttagataactatgatgcagttgttattcctggaggaatgcctggggcaagtaatttaagagatgattcacgggttattgatcttgttaaacaatttaatcatgatggtaaaataattggagcaatctgtgcgggaccgattgttttacaggaagcagatgttattaaaggaaaaaccgtaacttgttatccaggttttgaagaacagttaattggttctaattatcaagaagcacttgtccaaagagatgagaatattattactggaaaaggaccagcagcagctctagcttttgggtacacattgctagaagcacttgggtgtgatagtagtgtgataaaagagggaatgcagtatacttatttagaaaaaaatatttaatcaaattactttaaatggtaaatgaataggattataatattactgttaaataaggaggaaaatgatatggctaaatttgtatgttctgtatgtggatatgtttatgaaggagatgcagctccagaacaatgtccagtatgtaaagttggggctgacaagttcgttgaacaaacaggtgaaatgacttgggcagcagaacacgttgtaggtgttgctaaagacgtagatgaagagatcaaaaaagaattaagagcaaactttgaaggagaatgctcagaagtaggaatgtatttagcaatggcaagagttgcacatcgtgaaggatatccagaaattggattatattgggaaaaagcagcttatgaagaagctgaacatgcagcaaaatttgcagaattattaggagaagtagtaactgattcaacaaaaaagaacctagagatgcgtgttgaagctgaaaatggagcaactatgggtaaaacagaattagctaagaaagctaaagcattaaacttagatgcaattcatgatacagtgcatgaaatggcacgtgatgaagcacgtcatggaaaagcgtttgctggattattaaaacgctatttcggataattaagaataattttttaaattaaagcaataaaagtaggtatataaaaggataaaatttctttaagtatacctactttttattatgcttaatttatttaaaaatagtgcttttcaatttgagcaagtgaaaacaatacagtaaaagtaaagaaaagttcaacaatactattgattacgccaaacataatgataaacattccaattaataagactaaactcctaaatagagtagacatttttttataaaactgataatcatctaacatgatacgattaattagtaattggataataaataatagggagatggttcctgatgatgaaatgaggacatggagaaccgaaacaatattttcattatcaggatgataaggtaaataggaacctgtcagcatggaaataaaacaactcccgattaagaacttatttgcaatcgttagatacgtaatatgtttaaaaagtttaattaccttaaataataagaaacatgaaattaatgtaacccaaattaaataatatattcttaaatgaggttgataagataagtaagtaaaattattatatgcccaagaggtttttaacgacattaaaaaggtgattataaacataaatagatacatttttcaacccccaataatgttattttaataaaattctaaaaaattgtaaataataaaagaaaaaatgaacattgaatagtaaataatattataggaggattttaaaatgaaaatcaaaatgaagagtattcatgcaaacattattaatgaaaccgtatcagcaagtgccacggatgttcgagcacagatagaaattggatatagtcacgatgaaaaaaatcgattgcagcttaattatcatatatctgtaggtaagcaaaacagtgggcatttatatgttattaagtgttcttttgtcttgattgatttctcaacagaaatgtctgaaaaagagattttaaatgaagcagtagaaaatttacaagaacgtattgaaattatattagccttattaactgaagaaatgggttttgaattactttcatgatgaaagtgattatcgagtaacaaactaaattaattatcatattttatagtagaggtggaatatgatagtttatataaatggaaatgataatcgttgtaaacaattagcaaagctaatgattgcagatggttatcaaattcaagaagatagtaggctgatatcttcttgtgatattatttatttaggtaaagatggtcaggggtttgaacaagttgattttaaaaataatgctgtagtactttcattattaaagaatcagcgattatgttatttaagtaagttaaagggatttaattatcgttacttgtatagtgatgaagactttgttgttgaaaatacgcatattagtgatgaagcagtgattgcgtatatgataattgataattcaattagtttgtcaaattctaatgtgttaatcttaggttatggtcattgtggacgcgatttagcagctaaacttgaaaaatttaatgcgaaagtcagcattagtaatcgcagtgatcattatcatgatgaagttgttgaaaaaggatatcgttatattcggttggatcagctcactttaaatgggtatgattttgttattaatactattcctagtcaaataattgacagcgatattctaaaaacaaaagatgttaattgtaagatttatgatgttgcttcaacaccatatggtttaaaaacttgtgatcgtgatgaaagttatcatctattaaagcagcttccgactaagtatgcctatgatagtagtgcaaaagcgctttataaagcaattaaacgggcagttgatcaatatgcttaaaaacaagaaaatcggaattggattaacagggtctttttgttcgctacaaaagacgctggctgtaataaaagaattagcagctttagaatgtgatttatatatatttgcaagtgaaaaaattttaaattgtaatactcgttttaataaagctgacgaattaattgatgaattagaaaaactttctaaaagaaaagtaattactaatgttgtagacagtgaaatatttggacccaaaattcctttggatataatgattgtaatgccctgtagtggcaacacattagcaaaattagctatagggataaacgataatgctgtcacaatggcttgtaaatcaacacttcgtaatgaacataatgttgttttagcaatcgcgacaaacgatgctttaagtaattctggtaaaaatatcatgcaaattttaaatactaaacatttttatcttgtcccaatgtatcaagatgactgcataaaaaaaccaaatagcatgttatttgatgagactcttgtaattcaaacagtaatcaatgcaattaataataatcagctccagcccgtttttgagggtgtaaaagatgattagagttttaaaatttggtggaactgctttaaaaacaaatgattcaatcaaactagttactaatgttataactaataatttggatcataaattattagttattgtaagtgctatgggacgttatccagatgcttatgccactgatacattaaatgcactagcacttaatgctaactatgatgaacattgtcgattgcttagttgtggagaaataataagtagtatcgtgttatctagtaatttgaaatcacaaggaattaatgcaatctcgctttcaagtatgcagttaaatcttaaagttaagcataatcgtttagttggcttagataccaaagtaatcaataagtattttgaaacatatgatgtcattatcgtgccaggatttcagggaatagataaatttaaaaatattcgtattctagaaaaaggggatagcgattatacagcagtatacctagcacgacgtttgaatttggatgaggtatatatttatagtgatgtttgtggcatttttactggtgatcctaaatatattaatgaagcacgacttatcaagcatattggctatcgtcaagctcttgatttagccaagcacaaagctcggatcatttgttacaaagcattgatggaagggtataaaaaagatggctttaaaatcaagttacgttcttttaaagatgataggattggtactttgattaatcatgatgatacaaatatccgaacaatgtcaattgattttaattattggctaattcgttttgaagaaacaatagctaaaagcgattatagtttccttcatgattgctttgacgatgattatttaatttttgaagaagatttagctaaactagaaactgattatactaaaatagatctttatacaaaagtacattttgttggttgtggattagaaaatgatgagatttatcggaattttcttgaaaaatttgcaattgtttctaaaaatgaacatgatagttattatgtgaaagcaaaaaatcaaaaacaagatttgaatcttttacatgatttggttgtaaggagtgattaaaatagatatttttactaatttaattactccctttgatattgatgatatgattgattatcaagcgctagataatcatattgaaaaattagtaaatcaaggaaataataaatttattattggcagcaggacaggggaagctgcttcattgacttttttagaacaaaaacacttattacgatatgtttgctatcactatcctggtcttgaaatatatatgcagcttagtgaatcatgtacaaaaaaagtaattaaacagataggagaccttaaagacattaacgaatttgctggctatatgatcgagttaccagaaatttttagtttaacccaaaacggattgattaggcatcttgatctaattgctactgcaactaataaatcgattgttattcaacaacataagcaaaatacgattgctgttaatcatttattggaattgaaagaaaaacatgaaaatataactggcttgattactgaagtaaatagcacaggttatcagattattagaaataaggggttaggtctatacggtatagaagagatgctagtgcaaaatgaaattaataattatgatggacttattagtaacttaactaatctaagttataaaaagtatagagaattaattactcagcataatgatttatattttgatttttttaaattaatagttaaatatttttatcaagataatattgtaagtacattaaaatattcgttgagccaaagtagcaatattctttataagttacgtttgccattagttaaaatcagtgatgagtcaaaagaacaattgaataaaataatggagaaatattaatttatttctccattatttttgaatcacgaaataaaaaaagatactttaaatttatttatttatttaatgaggcggatgttatatactattaaaaacggctagataactatgaaaaagtagatactcgtaaagtctaattaaagattagagtttgaattttaaggagacaatataatgaaatttgcatttataatcatgggagattttaatttgaaatatgatcatgccgcaatccatcaacagacagcacaaataattggcgttactaatttagcagaagcaagtattgtggcaaaaaattatttattgagggagttgactgcatcgaattatgcggtgcttttggaaaagcaggagctaaaactataattgaagtgacggaaaataaaataccaattgggtatgttacgcatttaccagaacaagatgaaatttacgatctcacttttgctaaataatttcttaaatgaacacggctaaaaaaggttattgtgttaataatattacatgttaaagatgttagtaaaaattaaatcatttctcttttcttgagaattttgatacaatgaacgtagaaagtattagcaaacgatactataatatgttaatatggtaaagattgtttttcagcgatgattaagaaataatatagattataataatggaggaaaaaatgaagaaagatgttgttaaaattttaccacttggcggacaggctgagatgggtaaaagtatgtactgcatcgaaataaaagaacagatttttattttagatgccgggtttagattcccagaagtaagtaaattaggagtggatatcattattcctagttttgattacttaaaagaaaataaagaacgagttgtagctatcatcataacgcatggtcatgatgatgtgatggcagctttgccttacttgttagaagcggtcaatgccccagtttatgctccagcactaacagctgatctaattgaacaaatgatcaagcgacataaaaaacataataattttagagtgagttatcagttaaatcgtgtaaaacgcaatgattcaattattattgctggcattcctgttgaattttttccagtaactcattcgattcctggtagtgttggagtggctttatggactgataatggatatatcgtttatagcggtgaatttattgttgattttggtgccccagaaggatttagatgtgatattcaaaaaatgatggagattggaaaaaaaggtgtattagcacttttatgtgagtcatcttattctaaaaatccaggttatacatcaccaaaacataaattgacagataaaattgataatatttttgaagatagtgaaggacgaatcattatttcaagttatgctcaaaacatttttagaactaaagaaattgttgaactgacgaagaaatataatcgaaaaattgttttttatggtcgtgataaatatgatagcacaaatagtattgtccgcattggacagcgtttaaaaaaagcagtgattcaagtaccaaaaaatcttattgctttttctactgatattggtaaaaaaggaattgatgataatttagtagtgttgctcagtgggacaccgcaaagaatctatcatgatatttgtgatatcattgatggtggggatgagtttttaaaattaaataaaaatgatacatttattgttgcttctccagttattcctggaacagaaaaaattgcaaataaagcggtaaatgaattatataagacagattcaaatattcatgtattaaaaaataaagaattatgttcgatgcatgcatcgcaggaagatattaaagtaattatacaaatttttaatccgacatattttgtaccagttaagggtgagtatcaacattttatttcaaatttggaagttgctaaaaatatggcaattaaaccagaaaatattgctattatcgataatggtgaaattttatcgtttaaaagtggaaaactagaagattatcgcgatactattgaagttgaagatgtaatgattgatggaattggtgttggtgatgtaggtgataaagttattgatgatcgaattcagttgtcaaatgatggagtagtcattattggagtcacgattgatagtaaaactcatgaaattattgccaatactgatgttcagtcacgtggttttgtttatttaagggattctgaacatattattaagggagttattgatattgctgaaaaatgtgttagtgaaatgaaagatgatcctaaactagaagcagtagaagttcgacaaaatattaaagataaagcaaataagtttattattaaagagacaggtaaaagacctgtaatcttgccaattatcatcgaagtttaagcaagtttatccttgctttttcttttgctaaatagatatgatatggtataatgattgagttagagttgggagtgtgagtcatggcgaaaacaagtcgttcaaaaaaatcaaaacaagatcaaattagtgaggatttaaaagtaagaatcattgctacagtaggcttgtttttaattgttgtcggggcaatgaaattaggaccaattggcgaacaactgaattttttgtgtacttatataattggaaattttgttggaattagttatatttcattggttttgattagtgggtatgtaatttattttgctaaattaccaaaatttactggtcctcgtgcaatcggattatacatggtggtaggggcagttttgacttttatgtcatctttaaatgatgatttaatggttggaatgaaagtaattaatcaatatgtctcaacagcaccttgtaatcgaggtggatttctaggagctgttttatatggcattttaagtgctttgtttgataaaacgggggcaatgattgctgctggttttattttagtaattggtttaactttgttaggtagtaagttttatttagaacatcgtaaaaatgttgctgaaagaaagaaaaagaaacccactaaaaaagatattaaaatgcatcaaagcgctagtaaattcacagatttttttacccctaaaaaagataaagcaaaaggcttttttccagaggagatatttggtgatgaaaatacttcaagtcaagagcaagatccccctggaaagagttcagctcgaatccatactactcatttagaagaagatgaatcagtaccctctacatttgaatttgatgaggattctatgactttagaaattaaagataaagaaccaaagatccatgaaaatgatatgtctaaacctaagaaaaagattaataagaattatcgtttacctgccttatccctattaaaaaatcctacagcaaaaaagtctggtgataataaaggaaatgcattatctaaagctgaagcactaacaaatgttcttcatgaatttggagtaaacgcaacaattagtgatatttttattggaccatcggttactaaatatgaattaaaattggaaacgggcacgcgtgttaataaaattatgcaattacaagatgatataaaattagccttagctgcaaaagatattcgtattgaagcaccaattcctggtaaaccggcagttggagtggaaattcctaatagtgttgcaacaatggtaagtttcaaagaagtaattaaagacattccaaaagatttacaggataacaagttgttagttcctttaggcaaggatgttagtggtaagattatttatgcggaattaaataaaatgccccacttattgattgctggggcaactggaagtggaaaatcagtttgtgtaaatactattatttgtagtattttgatgcgtgctcgaccggatgaggtgaaatttattcttgtcgatcctaaaaaagtagagttaactaattataatggtatacctcatctattagctccagtagtaactgatcctaaaaaggcagctgcagtattgcaggaagttgtagtggaaatggagcatcgctatgacctttttgctggggcaaatgtacggaatatcgaaggctataataactatgcacgtaaaaaaaatgaagaattagctttggacgaacaattagagatcttaccttttcatgtagttattttagatgaggttgctgatttgatgatggtcgcaagcaaacaagttgaagattgtatcatgaggattgctcaaatggcgcgggcagcagggattcatttgatcgttgcaacacaaagaccatcgactgatattatcactggagtcatcaaagcaaatattccatcaagaattgcttttgcagtctcttctggaattgattcacgaacaattttggatgcttctggagcggaaaaattattaggaaaaggagatatgttattttcaccaatgggttctagttcaccggtgcgggttcaaggtgcttttgtatctgacgatgaagttagtgcaattactcaccacactgctactcagcaggaggctagctatgatgacaaatacataaatgtaaaattaaatactacttcaccaagtgctgcttcgaaagaagaagaggaagatgaagaatatgaaatgtgtcgcagttttgtaatcaatgctcaaaaagcaagtacatctttattacaacggcagtttcgaattggatacaataaagcagcacgaatcatcgatcagttagaagcagacggtgttattggaccacagattggctctaagccacgtgaagtttacattcgcggatatcaagaagaggacatctaaatagatgtcttttttgtatattttataaaaaaacgggaataataaatgtaatcgctttcaatttttaaggaagaatgttaaaataaagctatagtttattgaaggaggaaaattgaatatgaaaaagcttttggcttcacttgttgtattctcatttctattagtgggatgcggtggtagtagcagtgaagaatttgaagtagcacttgtaacagatgcaggggatattaacgataaatcgtttaatcagtctgcatgggaagctgttgaacagtatcaaaaagatcatgatgcaactatcaaatactataaaccagcaagttttgatgatgctggctacaaatcacaaattgaagaagctgtagaaaatggggcaaaaattattgtttgtccaggttttaaattctgtaatgcaattggtgaattacaagataaatacaaagatgtcaaatttatcttgattgatgctacaccaacagttccagatgagaaggatagtactaaatctaatccagttgatcctggtgataatgtttattgtgcattgtatacagaaacacaacctggatatttagcagggtatgcagctgtcaaagcaggtcacactaaacttggatttatgggtggaattgcattaccagctgtaattaattatggttatggatatattcaaggagcaaatgatgcagcaaaagaattaggtgttacagtcgatatgatgtatacatatacaggaacatttaatgaagatcctgcgattaaaactaaagctgctaagtggtatgatgctggaactgaagctattttctcatgcggtggtggaatttgtaactctattttccctgcagcaaaagaagctggcaaatatgcaattggtgttgatagcaaccaaaatgatgacaagacaggtgttgttattacttcagcattaaaagatgtaaaaaagacagtttatgataaattagtcgattacaaaaatgataaatttaaaggtggtatcgaaacattagatgcatcaggtggttatgttggtttaccagatgactttgatcgtttgggtgattttaatgctgcagcatacaaggaagtatttgataaagtggcaagtggtgaaattaaaatcaaatcaatgacagatattactgacaatgataatggtaatcctactaaagtacctgtcactaatgtaaatattacatatgataaataataaaaagcgagacaactcgctttttttaaaagtatttctcaatctaaccgagaaaaatcaacattagataagaaaggagtgacggtatggaatatgtaatagagatgttgaatatcactaaagaatttcctggaattaaggctaatgataatataaccgtacaactaaaaaaaggtgagattcatgctttgttaggagaaaatggagcaggaaaatcaacattgatgtcaatcctattcgggctgtatcaacctgacgagggatgcattaaaattaacggtgaaattgctgaaataaatgatcctaacgatgctaatcgttataaaattggaatggttcatcaacattttaaattagtcgaaacatttacagttttggataatattattttgggtgttgaagaaactaaaaatggattattagccaaagacaatgctcgtaaaaaggttcttgatctttccaaacaatatcatttaaatatcgagcctgatgctcttataaaagatataacagtagggatgcaacagcgagttgaaattttaaaaatgctctttagggataatgagattttaatatttgatgaaccaactgcagttttaacccctcaagaaattgaagaattattgaaaattatgaaaggattagttgccgaaggaaaatcaattatttttattacacataaattaaatgaaatcaaagcggtagctgatcgatgtactgttattagaaaaggaaagtacgttgctactgttgatgttacaacgacctcaaaagaagaattgtcaaagatgatggtaggccgtgatgttaattttattgttgaaaaaggaaaagcaactcctgggcaaacggttttaaaggttgaaaatctcaattattgtaagaaaaacgctatgaaaaatgccttgacagatattaattttgaagttaaacgtggtgaaatagtctgtattgcaggaattgatggaaacgggcaaagtgaacttgtatatgcattaactggaatgttaactggatatacaggtaagataattttaaataatgaggatataacccattattcggttaggcaaagaaatttaaaaggaatttcccatattcctgaagatcgtcataagcatggactagtactagattataatttagcagaaaatatgattttaaaaaattattttaataaagataaccagaaacatggtttcttaaaatttgagaacatttataattatgcagatagattgattgaaaaatttgatgttcgttctggtcaagggtcacattcgattgttcgaggaatgtctggtggaaatcaacaaaaagcaattattgcgcgagaaattgaaagtaattgtgatttattgattgctgttcaacctactcgtgggcttgatgttggagcaatagaatttattcataaacagttgattcaacagcgcgatgagggacatgcggttttactaattagtttagaacttgatgaagttatgaatgtcagtgatcgaattctggtaatgtatgaaggagagattgttactgacttaaatccaaaagaaactaacgttgaagaattaggattgtatatggcgggatcaaagcgaggtgttggatatgaaaaataaagcatggacaaaatcatttttatcttctttgattgcgattttatgcggtttgatttttggactactaattatgtttttagtaattcctaatcaggcattagaaggattttcaatcttacttcgaggtggtttttatcgtggaattaaaagcgttggtgaagtattatatttatcagtaccaattatgatgaccggtctttcagtggcttttgcatttaaatgtggtctatttaatattggaacaccaggacaatatattgtaggagcctttgcttcaatgtttatagcttttaatgcaacttttatccccgaatctattcgttggatctttgctgtgcttgcaggaggattagcaggagccttatgggccagtgttcctggattacttaaagcttatcgcaatgttaatgttgtaatatctagtatcatgatgaattatattgggatgctattagtaattgaaggagtaaaaaaatttatgtataatcccactggcgctgaatcgtatactattcctacaagtttagcaataccaaatttaggattagatcaggtttttaatggttcgagcattaatttaggaacgttcattgctattggtgtatgtattcttgcttatgttattatgaataaaacaacatttggttatgaactaaaagcaactggatataatccagatgcgagtaaatacgcgggaatgaatgagaaaaaaagtattgttttatcgatggtaattgccggtttttttgcaggactaggtggagctttggtttatatggcgggaactggacgaacaataggaacagcagaagttttagccgctgaaggttttaatggtattcctgttgccttattagggtttaacaatccacttggcgtgattttcgctgcattatttatcgcatatatcaatttaggcggaaactatgttcaagcagtacatattgcagtagaaattatcgatgtaattgttgcagcaattatttattttagttctttcacattgtttattcgattgattttagaacgccgaaaggggcgtaaaaaagataaaaaacaagctttgattggaggggatgaataatggatttattttatttcttatttagacaaagcttgatgttttcgatccctctgttgatcgttgctttaggcgggttgtttagtgaacgctctggagtagttaatatcgccttagaaggaattatgatttttggagctttttttgggatttggtttatgcatactgctcaaaatgccggctggttaagtgggcaagcattgtttctagtagctttattaatttctggagtaatcggtggattatttgcgctgttacatgcttttgctgcaatcagtatgaaagctgatcagactatttctgggactgcattgaatttatttgctcctgcttttggaatttttgttgctaagactatttttggtggagtaaaaagtattccgttcagtaatgaatttttaataaaaaaagttccagttctttcagacattccaataattggtgatatgttttttaaagatttttatctttctacatttattggtattgctattttgattgctacatacgtgtatctctataaaacgaaaacaggattaagaattaggacatgtggtgagaacccacaagctgctgatgctgctggagtaaatgtatataaaatgcgttatttaggcgttgttctatctggaatattggctggtatgggtggtttaatctatgtaatcccaataacaagtgagtattctagtacagttgctggatatggattcttagcattagcagttttaatttttggtaactggacaccttggcgaatcgcattgtcagcaattttctttgcttttgctaagactttagctgtaacatatgcttcaattccatttttattaaattctggagttccaggtgtagtttttaaaatcttcccttatgttgccactttaatattattagcttttacttcaaaaaattctgcagcaccaaaagctgctggagaaccttttgataaagcaaaacgttaatttgttaaaaagaacatcatcatgatgttctttttaacttgttctttttaagatgcggttttaatttttattttttagtgtataatatatacattaggtttgtaaaggagatttttatgaaaaaaagttatcaattagctggatatacactacatgttattccaagcaaaaaatttaagaatataacaatgtcattaaaattagaaggaaagttaacaaaagaaaatgttactaaacgttctttattggcttttatgcttactggaggaacagaaaactatccctcaactcaagcattatcaactcatttggaagatctttatggaatgagttttggcactaatttagcgactaagggaattggacaagtgttaaatatttcaagtgtttgtattaatgaaacatttttgccgtatcaagaaaatttattagtgcaacaaatcaaaatgtttaatgacgttttatttcatcccaatgttagaaatggaaaatttgatgaacaaacttttgctattaagaaaaaagaattaaaagagcgtttgattgttcaaaatgatgataaatttatgtacggattagatcaattattcaaaaatatgggtgagggtggttttttatccattagtaataatggctatgtagaagaacttgatcgaatcactaatgaagaggtctataaatacttagttgaatgcttagagaatgatgttaaacatttatatgttgttggtgatgttgatgaaagtattgtagatgtatttaaagaaaatctaagttttagcagcagcagtcaaccgcttgatccagttactaatttcaaatcaagcaagaatgacatcttagaagtagttgaaaaacaagatattactcaagctaaattaaatataggatatgttgttgattgtaactttaaggatcctggcacttatgcgatgactgtatttaatgcaatttttggcggattttcacaatcacggttattcaaaattgtccgtgaaaagcatagtttatgttactatatatcatcaagctatggggcatttagtgggattatgacagttaatgcgggaattgaaggcagtgactatcaaaaagctaaggacttaattgcccaagaattaaagaatattcaaaatggtgattttagtaatgatgaaattgatttagcaaaactgatgttaaaaagctcattaacaaaaactaaagatgaaccaattagtttgattacattggcttataaccgggatttaacaggtgttcaagaaacaaatgatgaatatttagaaaaattaatgcgtgtatccaaagaagaaattattgctgccagcaaaaaagtacacttagatacaattttcttattaacagggagtgataaataatggaaaaaatatactttgatactttaaaagaaactttatatcatgaaaaaatggataacggattagaagtttatcttttaccaaaacaagggtttgaaaaaacttacgggttgttttcaaccaaattcggcgctattgatacaacttttgtacctttaaatggtaatgaaatgattaaagtagaagacggaatagctcatttcttagaacataaaatgtttgatatgaatggtactgatgcttctgatgagtttgctaaattaggtgccagtaccaatgccttcacttcatcaagtagaacagcctatttatttagtactacttcaaatgaatatccatgtattgagttactattagattttgttcaaagattagatattactcctgaaagcgttgagaaggaaaaagggattattggtcaagagataaaaatgtatgatgatgacccagattggcgtgtttattttggatcaattcaaaacctttacaataatcatcctgtagccattgatattgcgggaacagttgaaaccgtaaatcgcactgataaaacaatgttggaaacttgctataatactttctatcatcctagtaatatgatgttatttgtcgtaggtaatattaatgccgatacagccataaatgtaattagagaaaatcaggctaaaaagaattttgaaacagcacaaccaattatttgccagaaaaacattgaaccttgtaaggttaaaacaaaagaaaatattttatcaatggatgttgaaatgaataaaataattgtttcaattaaaataaatgaaattctttctgaacctaaagaaaaaatcaaacgtgagttatcaatgaatctattgtttgacttactattttcaaaaagttcaaaattatataacgactggttaaataaagggattattaacgattcatttagtgcaagttttacgcaagaaagagactatgcatttattcaaattggatgtgattgtgatgactatgaaacattaaaaaatcatttgctcgacttaattaaaaattttaaagagcttaagattgaagaaaaagactttgaaagaattaaaaagaaaaatattggattatttataaatttatttaatagtcctgaaagtattgcgaatttattcagtcgctattattttgaaggaactatcgctttgaatttagtcgatgaggtggctgatattcaacttaaagatatttataacacttttaaatattttgatattgaatacactagtacttgtattgttaagaaaaagtaataattttgtcacatatcgctatgcttaaagtgttgacacttaaggtggctgtgttataataattttggttagagagtaaataaatttccacatcatagataagggaacctgatctaaattgcggtgttgaaaacctgtctttgaatagggatcctaaagtatatttaaaggtgcccacctgtacttaacagggaaatatctaaagctctctaccttttttatatttaaggagaaaattaaaatgagtaatatagatccagaattaattgtaagaattaatgaattggctaaaaagaaaaaagatggtacaatcagtgaggctgaattagaagaacaaaaagaattacgtcaaaaatatttaaaagcttttcgtagtgggtttaagcaacaattaatgggtgttaaagttgttgacgaagaaggaaatgatatcacgccacaaaagctaaaagatgaaaaattaaaaaattaatataatttgtcgaaaaacttattttaatttatacgattttgtgtataataagaataagtttttatgtgcaaaaaaggagaattagaaattaatggaaacatcaagcttatcaatcgcaacaattcgtgcgttaggtattgataccatcaacaaagctaactctggtcatccagggatggtattagggtcaacaccggcaatctatacgttatttactaaggaaatggatttttatcacaaacaatcaaaatggtttaatcgcgatcgttttgtattggcttctggtcatgcttcagcattgttatattcaatgctgcatttatctggttatcaaatttctattgatgacttaaagaattttagacaatggggttctattactccaggacatcctgaatgtgatattactgatggtgtcgatgcttcttcaggacctttgggtcaaggaattccaatggcagcaggaatggctttagcagaaaaattcttagcttcaaaatataaccgtgagggttatgatgttgtcgatcactatacatatgcattatgcggagatggtgatatgcaagaaggcgttacttatgaggctgcttctttagctgggcatttatcgttaggtaaattaattgttttatatgatgccaataaagttacgcttgatgggccgttatcaatgtcttttagtgaagatgtgaaaaagcgttatgaagcaatcggatggcaagtaattcgtgtaacagatggaaatgatgttagtgcaattcaaaaagcaatccgtaaaggaaaaaaagaattatataaaccaactttgatcattattgatacagtgattggttttggttcaagtaatgaaggaactaataaagttcatggtaatccattaggaaaagaagatggtaaaaatgctaaaatttcttatggctttgatcatgacgaattttatgttcctgaagaagtttatgatgattttgctaatacatgtattaaacgtggaaaaaatcgttataataagtggcagcggttaatgaaagactataaaaatgcttatccagaacttgctcaagaattagaaaatgctattgctgggaacttttcattagatttagatgaaataatgaaaaaatattcacctggtcataacgatgcaacaagaaacacttcattagaaatgattcaagaagttgctcaacaaaatcctacatttatgtcaggaacagctgatttagcatcttcaactaaaacaaatattgcaggcgaaaaaacatttagtgttgaaaattatgatggccgtaatttagcgtttggaattcgtgagtttgctatggttgcaatgatgaatggaatcactttacacacaggaataaaagtatctgcaggtggtttcctagttttctctgactactttaaaggcgctttgagaatggcttgtttgatggaattgccaatcattttaccattatctcatgactcgattgcagttggggaagatggaccaactcatcaacccgttgaacaactaacaatgttacgttcaatgccaaatatgcgagtatttagaccagcagatgctgtcgaaatggcatctgcatggaaattagcagttgaatcaactaataatcctacagctctaattttgactcgtcaaaatgttaccacaatgactgcaacttcatacgaaggtgtttgtcatggagcctacattgtaggtaaagaagtcaataaattagatgcaattattatcgcttcaggtagtgaagtaaatttagcaatggcagctaaagaagaattattgaaagaagatatcgatgttcgtgttgtatcaatgccatcaatggagttatttgaacagcaagatgctaaatataaagatgagattcttccacacaatgttagagctcgtttatcgattgaaatggccagtgattttggttggcataaatatgttggtttagatggtaaaacaatgtcagtaaataaatttggtgctagtgcacctgctgatatcgttattaaaaactatggttttacagttgaaaatgtagtaaaaaacgttaaagatattttataaggactagtaaaagtgatgtaataacatcacttttattgatttttgggcatgatttgacaatatatttagattttctttgatacactaatcatggtgatagaaatgaatacatataaaatatataagttaaatcctaatgttgttggattacttgaacaatatccagaggtgaaaaatcaaattattaatattgaacctaaaaatgttttttttacgaagcaaatggagtgtttatttggaaataatgaaggagttagtgactttatcgaatacaagttaaaagaccgatacgattatcatcgggataaaaataaacatgttattgataatcaattaacaaaagaagaaatgatttgcgttattcatgattactatataattattgaagcaaataaaaaaacaaatatattcttggatattttataccaaatatcaaaaagttatgttataatggtagagcaatctaaaaacttggaggtataaatatgttgaatataattttgggtttaatcgttggtgcgattatcggttttttcgcagcacgttatatgtttaaaaaacaattacaaaaaaatccaccaatcaacgaaaaaatgattcgtgcaatgtatatggaaatgggtcgtaaacctagtgaggctcaaattaaaaaaatcatgtcatctgttatgtcacaatataaataaggggtaacccttatttttactttatgaaaatataccttactcgacactcaaaaacattgtggaatcaagaaaaaagattacagggatggcaagattcaccgctaacagcagaaggcatagaagatgctaagttgctaaaagcaagaatcacagaacttaaaattgattattgttatagcagtccgatagaacgtgctaaagcaacaagtgaaatattatttgatcatgttcttgttgacgaacgattaaaagaaatgaattttggtaaatacgaaggatgccttattaatgaattattaaatgatccaatttataatcgattatggaatcttccggatgatgatgttagcactcctggtggtgaaacatatcatgaagtccaaatgcggttaaaagatttttttaatgatatttataaaaaacatcatgatgatacaatttttattacgattcatgggatgttatttattattcttcacggaataatgcttaattataaaacatccgaattaacaaaaatcaataaatatgttgttcgtggttgttctttaagtgaagttgaatatgatggaaaagaatttaagattaaatatattggtgatgatagtcatctaaaaagtagtgaaataattacatataaataattacctaatggatgcatctctttttggataatgcatccttatttttattaaataaaaaagccgtgataattcacaactttatgtattaacgagcatatttacatccaagtaattttattttctgtcccatttttaattctaattaaattttctttgtgtcgataaattaacagtaaaataaccgctgcagttacgattttaccagtcattgacatatttaaaaacggaattgcaaacaatactgaagacgatgctaaaactgaagacagtgaaacatatttagaaagctttagaacaatgaagaaaacgactaaggctaagacagcacctataggattgacagccataaaaaaaccgattgcagttgaaactgctttaccgcctttgaaatttgcaaaaacaggatagcagtgcccaatcacacaagctaaagcacatatatatgctaaatcattattcatttttaatagtgaacataagtaactagttaaaagcattactaataatgcctttgaagcatccaaaagaattacagcaacaccagctttttttcctaaaacacgaccagtatttgttccccctaaattaccggaaccatagtttctaacatcagttttatagactaatcgcccaataactaatgcaaagggaatcgatccatatagataactgagtataattaaaattattgaaatcattatatccattttttatcacctgtgactattatatattatcattataaaaatgcaataatctttgaaaaaaacctaaaatttaggtataatggtacaagtgattaaaggaggcagatgaattatatggcagctaaaagtaattatgatgagtcaaatattcaaatacttgaaggcttagaagcagttcgtaagcgaccaggaatgtatattggttcgactgatgcacgcggactgcatcacttagtttgggaaattgttgataatgcaattgatgaagcactttcaggatttggtgataatatacaagtaacgatttgtaaggataacagtatcaaagtaactgaccatggtcggggaatgccgacagggatgcatgcttcaggtaagcctacaacagaagtaatccttacgattttacatgccggtggtaagtttaacgaagacggcggttataaaacttctggcggattacatggagttggggcgtcggtcgttaatgcactatcttcatggcttgaagtaacaatttatcgtgatggaaaagtttggcagcaaagatttgaagatggtggtagtaaagttgggaagttaaaagtgattggtaaatcaaatcaaactggaacaacgattcattttatgcccgattcaagcattttttcagtttatgaatataatttttctacgattagtgaacgattgatggaaagtgcgttccttttaaaaggaatcaaaattgatttagttgatgaacgtacaggtaaagagataagttatcaatacgataatggtttaacagcatttgttgaatatttaaattatgaaaaagagactcttaatgaaattattaatattgagggtacaaataatgaaatagaagttgatgtcgctatgcagttcactagtggttatcaagaaactactttatcttttgtgaatttagttagaactggtgatggtggaactcatgaaacaggatttagatcagctttaactagaacgtttaatgaatatgctcgtaaatatgggttattaaaagaaaaggacaagaatttagaaggaaatgatgttcgtgaaggactttcggcaattatttcaattaaagtacctgaacattatttacagtttgaaggacaaacaaaatctaaactaggaacgccagaggcacgaaatgttgtagatacagtagtttatgaaaaacttacatattttttagaagagcataaagaaacagcagataatcttgttaagaaaatgattaaagctgctcaagttcgtgatgcggcacgtaaagctcgagaagctgctcgtaaaggtaaaggcccacgtcaagaaaaaattttaagtggaaaattagcacctgctcaatctaaagataaaaaacgtaaagagctatacttagtcgaaggagattcagcaggcggtagtgcaaaacaaggtcgcgatcgtaaatatcaagcaattttaccattacgaggaaaagttgttaatactgaaaaggcagcaatggctgacattttaaaaaatgaagaaattgcaacaattattaatacaattggggctggcgttggagctgattttaacgaaaaagatagtaattataataaagtaatcatcatgaccgatgctgataccgacggtgcccatattcaaattcttttactaactttcttctatcgatatatgcgagatctaattactgcaggaaaagtatatattgctttaccaccactttataaagtgtcaaagaaaagtgggaaaaaggaagatatcgtttacgcttgggaagaagacgaattagaagaagcaaagaagaaaattggtcgtggatataatgtacaacggtataaaggacttggggagatgaatgcttctcaattatgggaaacaactatgaatccagaaactcggactttaattcaagtatcaattgaagatgcggcaattgttgaacgtcgagtttctgtattaatgggtgataaagtagaaccaagacgagaatggattgaacaaaatgtccaatttacattagaagataattttgcaattgagtaaggagaaaataagcgtggataaaaaaataattatgtcattagaaactatcatgggtgaccgctttggaaaatattctaaatatattattcaagatcgtgctttacctgatgttcgtgatggtttaaaaccagtacagcgccggattctttattcgatgtataaagaaggaaatttatattcaaaaccatatcgtaagtcagcaaaaacagttgggaacgttattggtaattatcatcctcatggagacacatcagtatatgatgcaatggtccgtttatcccaagattggaaaatgcgtgttccattagttgatatgcaaggaaataatggatctattgataacgatccggcagcagcaatgcgttatactgaagctcgtctatcagcaattgctgttgaattactaaaagatttagataaagatacagtattaatgtctttaaactttgatgatacagaatatgaaccaactgtattaccagcggcctatccaaatttattagtaaatggtgcaacgggaatatcggccggttatgcaacagatattcctccacataatcttgaagaagtaatcgatgcaacgattcatcgaattaaataccctaactgttctttggaaaaactaatggaatttattaaaggtccagattttccaactggagctattgttgaaggaaaacaaggaattttaaatgcctttaaaagtggccgtgggaaagtgattgttcgtagtactagtgaaatgattgaagagaaaacgatgaataaaatcgttattactgaaattccctatgaagtaaacaaagcagaattagttcgtaaaattgatgaaattcgatttaatcgcaatatcgatggaattatcgaagttcgtgatgaatctgatcgtactggattacggattgttattgatttaaaaaaggatataaatgtacaaaatactcttaactatctatacaaaaatactgatctacaaaaaaattacaactataatatggttgcaatcaaagataagcgaccagtcttaatgggggtaattgagattttagatggctatattgcacatcaaatagatgttgttacacgaagttcaattcatgatcttaataaggctaatgagcgtaaacatatcgttgaaggattgattaaagcaatttcaattttagatgaggttgtaaaaacaattagacaatcaaaagataaaagcgatgctaaaaataacttgattgaaaaatatggttttagcgaaaaacaagctgaagcaattgtaatgttacaattgtatcgtttaacaaacactgatattgtcacattggaaaatgaaaataaagaattagataatcgaattgcatatttaaataatattttaaacagtgatgaggttctacgtaaagttattattgatcaattaaaaggtattaagaaaaaatatccaatgccacgtctatcaaaaattcgtgatgaggttcaagaaattaaaatagatgagaaagcaatgatcctatctgagaatatcaatgtttctattacccgtgatggatatattaagcgaattagtaatcgttctatcaaggctagtgaaggtattccgttcggcaaaaaagaaaatgactatctagtttcaatgtatcaagccaatacgttagatcatttattgctgtttactgatgctggaaattatctctttattccagttcataagattgaagaatttaaatggaaagatgctggtaaacatgttagttatttagtaaaactaaatgctggtgaaaaaatcatcggaactattttggtaaaagattttaatttaccattgtacgttatgctagcaacaaaaaatggtcaaatcaaacggacgaatttaaaagattttgaagttactcgatattcaaagccccttaaatgtatgggattaaagaatgatgatcgggtagtcgatgttaaattgactgataataatcaaggaattatcttaacgactaaagctgggtatggagcattatattcagagcaagaagtttcaatcgttggaatcaaagccgctgggattagagctgtaaatttaaaaaatgatgagttagttagtctcaatatttttaatccattagttagcagttcattaatcgttattagcgaagaaggtggggttaaacgaattaaaattggcgatataacaccttgcaatcgtgctacaaaaggaactttattgtataagaatcctaaatctaaaattatttatgtaaaagattccgtaattgttgataattcacaattaattacagtcactttaaacgatcagacttcatttgaatttaaagcaactgactataataatgctaatcttgagcaaaaaccaagtgtagctaataaattaacggctaatcaagtaattgatgatgtttatataaattctccaatttcaacaagtgattatgatgtagctaagaaaaccgaagttgatttagaaatctttaaacaacccaaagagcataccttattagatgattttgaaagtgatgaggttgaaactaccaaaaataaagcggttgttaaagtacccaaaaaaacagaaccaattaaatatgaaaaaatatctctagaagatattctaaaagaagatgatttttaaaccgtaaattatataatttacggtttttctttcatatgttcacgcaataatttaattaatgcacgtttttcaagacgtgaaacataagaacgtgagatatttaattttttagcaatatctttttgagtatactttttggtattattcaagccataacgcataatcaaagtatctttttcgcggggttcaagaacactaaaatatgttgtaaatttatctaaagtatcctttttatctactatatcgataaactcctcttgttttgcggcaatgatatcacctaaaactatttcactgccatccttatcaataccgattgtctcatttaatgaaatatctaagttagtctttttattagttctaagatgcattaatatctcattttcaatacatctggaagcataagtggctaacttagttttatggttttgtttataactatcgactgctttaatcagtcctattgttccaattgaaatcagatcttcctgcatatctttattgttctcgtattttttagcaatatgagctaccaatcttaaatttctttcaattaaaacattccgagcctctttgtcaccattaaaaaactgttcaagatatctttcttcctctttagctgttagtggtaactcaaaagattttgatttaatgtatgagacaaagaaaccattagtaagtaaggataataatgttgaaaacatttatatttcacctctaatacatatatattgtcaatcttttaatttaggacaaaaatctttatattcatccaaataaataaaattataccaagttttattttaacgattatttactttaaaattggcttaaaataaggtacaatgggagtggtttgaaaaggagatagtatgactaaagagattagatgttttggctgtggagccataattcaaagtgaagacgaaaaaaagataggttttgtgcctaaaaatgctttagaaaaagatgtaattctttgtaaacgctgttttcgcttaaaaaattatcatgaattacaaaaaacagatcttactagtgatgattttttaaaaattcttcaagaaatcggaaatcatgattgtcttgttgtttatttagttgatttatttgattataatggcagcttaataaatggattatcacggcatcttaataataatgatattttagttcttggaaacaaacgagatattttgccaaaatcactaaaagatcgtaaaattgagcattggctaagaagacagttgaaagaatcaggaattaaacctattgacgttattttatcaagtggaaccaaaaattataatttagatttattaatagataagattaatgaatatcgtcatggtcgagatgtttatattgttggagttactaatgtcgggaaatcttcgttgattaattctttattaaaacattatgcaggagtaactgataatttaataacaacaagtgaatttcctggaacaacgcttgatttaattgaaattccactagatgataaaaattatttatatgattcgcctggtatcattaataatcatcagatggctcatttagttaaagatgaagatttgagaataattattcctaaaagcgaattaagaccaattaattttcaattaaacgaccaacaaacactatattttggtgggttggcacgcgttgatttcattaaaggaccgcgtagttcttttacttgtttttttccaaaattattaaaaattcatagaactaaattgggaaacagtgataatttatataatcggcacttgactctgatgccggaaattgaaagtattaaggatattaatgaaatggcaagttatgattttaaattaccagagggtaaaattgatattgttatttccggtctaggatttgtcagtgttaattgtcccaatgccaatgttagagttcatgcaccacaaggtgttggtgtttttattagagaagcattaatttagaaaggaatcgggttatgttaacaggaaagcaaaaaagatatttaagagggatagcacataatttaaatgctatttttcaaattggtaaagaaggagttcatcaaactcaaattgaaggtattgacgatgctctagaagctcatgaattgatcaaagtaaaaattcttgaatcatgtgctgattcaaaaaatgagattgcgctagagttaagtatgaaaacaaaagcagatgttgtgcaaattttaggaagaacaattattttatatcgcccaagtgaaaaggaaatttataaattaccatgataaaaataggtgtttttggcggtagttttgacccaattcatcgttctcatgtacgcgtgattgaagagtcaatcaggcaattaaagttagataaaattttagttatgccgactgctaacaacccatggaaaggctctacaggagcaactaaacaacaacgattagcgatgttggaaattgctttaaagcgctataaaaatgttgaaatttgccgctacgagattgatcaagatagtagtaaaaaaaattatacgatcgatacaattagatatctaaaaaaaatatatccaaatgatcagttatattttatgatgggaatggatcaagcaagtttatatcataaatggattgctgctaaagaattgagtcaattagctcaattagtggtattcgatcgcataggttatcaaattaatgataatttagataaatataattttattcacttagatttggttgccagtgatgacgctagtaataatatccggaatggtgcattacatgctttaaatcctgaagttttaaaatatattgttaataatggtatttatttagaaacaattgtgaaaaataaaatgtctttaaaacgctatcgtcatacagtgagcatggctcatttagctaaagaaattgcattagctaataatctagatggtagaaaagcatatgtagcaggaatgcttcatgatattgctaaagaaatgcctcatgatgaagctgttgtaataatgcaaaaaaattatccagattatcttaataaaccagaggcggtttggcatcaatggttatctgaatatgttgcaaaaaatgagtatttagttgatgatcctgaaatattacaagcaattaggcatcatacaactgcttctttatatatgtcaaaacttgatatgtgtatttatgaagctgataaatacgatccaagtcgagattacgattcttcaaaaaaaattgcattatgcaaaaaagatgtagttgctggctttaaagggtgtttacaagatttttatgatttttcccatgaaaaagggcgaaaaattgatgaatgtttttttgaaatttataataaatatgcaaaaggagatattaatgaataaattagaagtaattataaaagcattagatgataaattagcagaggacattgtagtaattgacatgcagttagctagtcctatttttgatacttttgtgatttgttcagcaagtaacgagagattgatgaatgctttacgtgacagtgtcgaagacagctgtcatgaaaatggttatgaagttaaaaaaattgaagggttacgcaatagcaagtggttattgatggattatggtgatatcgttgtgcatatatttgatgctgacgaacgaaacagttataatcttgagaaattatggtctgatatgccacgaattgacgtatcaaaatatttagcttaatgtcatacgaaaattttgcttattactatgacagcttaatggatgaacaattttatgatgattatttcaagtttataaatgagcacgctgattttaaaagcgtgcttgaacttgggtgtggaactggtgaaattgcaattcgtttagctaaagcaggtaaagagatttatgcaactgatctttctaaagatatgcttgaagtttcacgtttgaaagcaatggaagcagatgttaatcttttattaggtcgagttgatatgactgattttgtaaccgataaagcagtagatttgattttatgcctttgtgactcaattaattatgttttgagtaaaaagaaagtattaagaacttttaaaaatgtatatgaatcactaaaatataatggaacctttatatttgatgttgatagtctttataagatggatgaaattctagatggctattttgaagaagaagatgctgatgatttctattttaaatggcatgtagaaaagactgctcttggtaaagtggaacacgaaattgagataattgataaggaaaataatgaacatataaaagaaatgcattatcagcaaacttacgatattgaaatttatcttagcttattgaaacaggcaggttttacggatgtacaatattatggtgagtttgaggaatatcatgataaatcacaaagaattatttttatatgtcataaaagaaggggaggtaagtagaatgattggaattatcggagcaatggaagaagaagtggcagcaattaaagaatatatggagattactgaaacacgctctattcttgattgtacattttatcaaggaacgataaaagagcgccaagtcgttttgttacagggtggagtaggaaaagttaatgctgctatttgtactactttattactgactaactataaaatagattatgtcataaatatcggttctgctggtggactgtgtttaactcaagaagttggggatatagttatttctaatgaagtttgtcaacatgattttgatattacggcatttcccaatcgagtgattggtgaagttccaggtttacccccaagaatagaagcagatcgtcaactaattactcaagctaaaacaatattatcaaacttaaatttaaattgcgaaattggtctaattgtttctggtgaccaatttgttgctacaccggaagtagcaacacgcattaaaaataattttcctgatgcaaaatgtactgaaatggaagcagcagcaattgctcaaacatgctataaattcgggactagttttattattacacgttctttaagtgatgtttttggtaagggagattcttctgtccaatttgatgaatatttaaaaaaagcatcccaagcgtcagctaaaatgtgtatagcattaattgcagaaacggagcattaatacatatgcaaaatatagaattacttgctccagctggaagttatgaagctttagtagcagcggttcaaaatggtgcaaatgcaatttatttaggaggaaatgaatttagtgccagagcttttgcaacaaactttaatcgcgaggaattacaagctgcagttgcatatggccatttacgcaacgttaaaatttatgtaactgtaaatactttatatgaagataatcagtttgaaaaactacaagattatcttttgtttttacaaacaataaaagttgatgctttaattattcaagatatcggactgatgagttttgttaaacaatactttccagattttgaaattcatatgtcaacacagactagtatttataatttgtcagcagttaaatattttgaagatgctggtgttgatcgtgttgttttagcgcgcgaaaatacacttgatgaaatagctgatatttgtcaaaacacaattctagatattgaggtgtttgttcatggtgctctatgtatgtcatattcgggacagtgtttaatgtcgagtatgattgctaaaagaagtggaaacaaaggagcttgtggacagccttgtcggctcgcttataaattgcaaaaagatagtatgaatttagataaaattccaagctatttattatcacctaaagatttatgtacctttgagaatattgggcaattaattgatgctggtgttacatcatttaaaatagaaggacggatgaaacgacctgagtatgttgctacaatcgttaaacaataccgtgaagcaatagatgcatatttaaaaaatacgacagttaatgcatttgagcagcgtataaaaaaaatgaagcaaatgttcaaccgtggattcactggtggatatattttaaaagatcaaaattttgtggctaaagattatcctggaaaccgaggaattgaagttggtacagtgatagattatgataaacatcgaaaaattgtaaaaattcaattacaagataagttgaaacaaggagatcggattaatttcaagagtgttgggtttactcgaactattacaaagttatatttatttaataatttgattaatcaaggcaatgctggtgatattgttgaaatcgaattgaataccccagtaaaaaagaatgaaacagtatataaggttattgatatagatctaatcaatgaagctttagcaagttataaaaatgaaaatattaaaaatacagtaactatggcattttcaggtcaaatcaacgaaccagcacgattaaccatcaactataaagatttaaaagttgaaaaagtttctaatcttctaattgaatcagcagctaaattgccattagatcctcaaagaatcagacaacaattaggaaaattaggaaatacagtatttaaggcaaatgatattactattgactttcctgataatggtttttttagtattaaagaaattaatgaaatgcgtcgtcaagcaatagatgaactttctaatatgatagtaaagataaaaaaagttaaaaaaccaatgattaaaactaaacataatcatattaataaacaaattaaagggattgtggtaaaaatttataatttggcacaattaaaagcattgttaacagaggaagtggatgcatattattttcctatcaacgaagaacttgatgaagctataagtttagcgcattctgtaaataaagaaataatcccatttacaagctttttgaataatcaggatattttaatcaagtttaaaaatagtgtctcatacaataagataaatagtattttagtaggtgactatggagcattacaaatttttaaagataaaaaatgtattttagatagtactttcaacctttataatagctatgctttgaattattttaataatcatgatgctattctttctctcgagatgagtagaaaacaagttaatcatttaaataatattaaacaaaatattataatgacagtgtatggcaaaacaatcaatatgcatctaaaacactgcttaataagtgatcattattttaattgtaaaaaaatcaaatgtaatctttgtaaacaaggaaagtttactttaattgatcgtaaaggtgaacaatttgatattttcccagatcaagactgtaataacttaatattcaatagtcactgtctttacattgatcatttagaaaaactagaagttgattttattttgctttcatttagtaatgaagcaccagaaatcaccaaagctgtatttagggatttcaaaaataatattatgtttgctaaacctcgacaaattagtttaaaaacaaaactaactaatggatatttttatgactaattatctaattatataaataaaaattattatttgtcgaaataaattataaatatacaaaatcttattgaagaaaaataaggaaaatgctaaaatctatttatcggaggtataatgatgattgataaagatttagcggcacgattaaaatcttatcggaatttcaaacacctgacacaaaaggatgttgctgcttatttaaaagtaccacattcagccatttcagatattgaaaatggtaagagggatattacagtaggggaattaagaatattttctaacttatatggacgaagtgtagaagaaataatgagtggtaaaaaatacgactactataatattgctaatatcgcacggttgttaacagagttaccggatgaagatttaaaagaagtaatgtttatgattgaatataagcgtaagcgaaatgaagaaaaaaatagaagtgagaaattttaaatctcacttctattttagtatttgcttaaattcttctaaaacgatttttccatcgtctagaaccatttttgagcattcttcaaaagtttcactattataataatttacttttatagtatcaccgatttccacgattgcaaaggttccgaaaccatatgaacctcgattgatcatcacactgcctggattaataatataacggttaccaatttgggtatatgcaggaacatgagtatgtccgtgaaaacagatatcaatattattagcaatcatatattgctttattttatcatttccgtagtatatatcgtaagcatttccatgagtaattaaacagcgatattttccaatttctaaaataatattgactggaaaatcttcatcatcatgattaccttttacagtataatatttgtttaacaagaaatcatctttttttaaggatgaatctccacaatgtaaataataatccatcttaggatatgtttgattaattttttgaaataattcattttgtaaatgagtatcactaattactaatacctgcatgtaaaatcacttccttctttatctatcataacatatttgaaaaaggataaaaataaagataattattctttgacaccaatggtctagacaagtacagaagaatagcggctgttatactataaaaaaagatttatttgaaatattttataaaagaaaaattaaaatttttagattctttttttataattccacttcaaaaaaacggtgttaaagagctttaaaaattgatgattctaacaaggaaaattttaaaatggcaagatttattaactaagagtagaagttattttttactaaaaaattcatttttaattgtaaaaaaataaagcatttcagccaagaaagtgtttacattctaagccattcggtgtaaaattaatttaggtaaaaaaaaaggagtgtatattattatgaaaactattttattagtgtgttcagcaggtatgtctactagcttactagtaacaaaaatggaaggtgctgctaaagatgcaggtgttgaatgtaaaatttttgcattaccattctctgatgcaccaagagtattagaagaagtagattgtattttacttggcccacaagttagattccaaaaagctgctattgaaaaattggctgctggacgtaaagcaggatctatccctgttgatgtaatcgatatgagagattatggaactatgaacggtaaagctgtatttgaagctgcaatgaaaatgattgggtaatcaaaaagcttaaactgaaataacaaaagataaaacgggcgttttttgtgatgccctttttatatgaaatttaacaataaaggagagagttagttatggcaacaagaattatgttagtatgtgctgcaggtatgtctactagtttattagtaacaaaaatggaagtagcagcaaaagaagctggagaagaagtagaaatctttgctttacctttgacagaaggtgaaaaaattattgatactgtagattgtgtattacttggcccacaagttagatatgcaaaaaaagaagttgaaaaaattattgcagatactggaaaagatattccttatgatgtaattgaaatgaaagattacggaatgatgaatggtaaagctgtttacgaatttgctaaaaaattaatgggaagataattccttacgattaaataaaaacggataaattttatccgtttttattttgacgaaatttcaagaaataggggttttatattgtatacaactatgatataatatcctaaataattaggaggtaggtaatagtatgcaaaaggggattattacagtagtaggaaaagatcaagtaggaattattgctaaggtttgtagttttttagcggagaaacaagttaatatcttggatatttctcaaactatcattcaaggttattttaacatgatgatgattgtagaactaagttcaattaccgaagaatttggaactatctgtgaagatttagataaattaggtgaagaaatcggagtaaatattaaattacaacatgaaaacatttttaataaaatgcatcgtatttaaggagaatcggaatgattaatttatttgaagtagcagaaacaaataaaatgattgagcaagaaaatcttgatgtgagaacaattacattagggatcagtttattagactgtatggatcatgatattgatgttttatgtgaaaatatttataaaaaaattactaccgtagctaagaatctagtctctacgggtaaacaaatcgaaatgaaatatggaattcctattgtcaataaaagaatttcagtaacaccaattggatttgttggctctaatgcttgcaaatcaacagcggactttgttaaaattgctaaaacattggataaatgtgctcatgaaactggagttaatttcatcggtggttatacagcaattgtttccaaaggaatgacaaaggcggaagaattattaattcgttcaattcctgaagcaatgaaagttactagtaatgtttgtagttcggtaaatgttggatcaactaaaactggtattaatatggatgcagtaaaattaatgggggaaatcattcatgaaactgcagatttaactaaggaaaatgattctattggttgtgctaagttagttgttttatgcaatgcacctgacgataatccatttatggctggggctttccatggggttagtgaagcagacgcaattataaatgttggagttagtggcccgggtgttgttaaaaatgctattgccaatgccaaaggaaaagattttggagagttatgtgaaattatcaagaaaactgcgtttaaaattactcgcgtaggtcaattagttgctttagaagcgtcggaaaaattggggattccttttggaatcatcgatttatcattagctccaactccagcaatcggtgatagtatcgccgattgtttagaaggaatgggcttggatagtgttggtgctccaggaacaacagctgcattagcaatcttgaatgatcaagttaaaaaaggtggcgttatggcttcttcatatgttggtggattaagtggagcatttattccagtcagtgaagatcaaggtatgattgatgctgtaaaccgtggcgcattaacacttgaaaaattagaagctatgacatgtgtatgttcagttggacttgatatgattgcgattcctggagatactccagtcactactttatctggaatcattgccgatgaaatggcaattggtatgatcaatcaaaaaaccacagctgttagaattattcctgtaatcggtaaaaatgttggtgaagtagtagaatttgggggactattgggttatgcacctgtaatgccagtaaaccaatttggatgtgctgaatttattaatcgtggtggtagaattcctgcaccaattcatagttttaaaaattaaaagacgttaactcgtctttttcattatattgaaaggaaaatgtaaaatgaatgatttaatagtttttaatccattgtataaaaataaagatattgctgagtgttttgcattatatactgaagtagtagatgggaaacttgaaaatagcagtaaatttgtttcattgttaattaaattagctgaaaaatacaacttgtacgataatctatttaatagtttattaacttatttgttaattaataatgaaaattcgtttactctagcattagaaagaaaaaaaacaatagctgctaatttaaaagaaattgttatgaatgattttaagattattttcaaaatgtttaatacggattttagtgtcttgccattagcacaacaaaatttgataacaggattcacaccttcaaagcctgtcattaatattgaactattcgaagtttcaaaaacattacaggacaatttaactgcctgtaatgatgttgaatcattttataatgtattagaaaacttctttttaacgtatggagttggaaaatttggattaaataaagcatttcgttatgaaaatgagcaaattagtcctataatacatataggtaatgggcgactagatcagttgattggttatgaaagccaaaaagaaaaacttacccaaaataccgaggcatttttagcaggaaaaaaagcaaacaatgttttattatacggtgatagtggaactggtaaatcaagtagtattaaagctttattaaacgaatattataaagatggtctaagaatgatagaagtttataaacatcagtttataaatcttcctagtattattcaagaattacagtcacgtaattataaatttgtattattcatggatgatttatcgtttgaggaatttgaaattgagtataaatacttaaaagcagtcattgaaggcgggttagaaaagaaacctgataatattttgatttatgcaacaagtaatcgccgtcatttagtaaaacaaacatggggtgatcgtcaagatcaggatgaggttaatgtaaatgatgctaaacaagaaaaaacatcattaagttcaagatttggtgttaaaattttatttatgcatccagatcgtcaaaattatttagatattgttgatggtttagccgaacaatatggtttaatgatggagcgtaacgaattgcatcaaaaagcattaacttgggaaattcgtcacggtggattttcaggaagaactgccaaacaatttattaatgcaatgctaggtaaataaaacaataggagtaatatgcgaaaattattattaaacgattatcacaaaataaaaaaatatttagacgatgcaaattatgagggctataattctaattttgtcacaatgatgatgtgggatcatgaatatgaaatatattatgaaataaaagataatttcatggttatgttacacacatatttagacgaaaagttttttgcaatgcctttttgcaaaccagagtactactatgaagcaatcgaatatatgcaaaactatgctaaagagcataactttctttttagaatcgatttagctgttgaagaatctatgagtttaattaaagaaagatatggagataagtttttgtatttgcataatgaagattttgatgattatgtctatacaaaaaaatctctagaatctttggcaggaaaaaaaatgcaaaagagaagaaatcactttaatgcgtttgttaaagaaaatccgaattatatttataaagaaattgaagatgaagatgttgataatgttttacagtgtctcaaaaaatgggatttttctcatcgaatagaagagagtgttatttctgagtatatcgggattgtctacttgttagtacatcgtcatgaattggaaataaaaactggctgtatttacattaacggacagttagaagcatttattattggttccccacttaaacacagtaccgttcaaattcacgtagagaaggctaataaagatattagaggattatatgtggcaattggtaaattcttcctagaacgaaattttgagggttatgaatttgttaaccgtgaggaagatatgggattagaatcactacgccgtgctaaacaaatgctgcacccagttaaaatggttaagaaatataatattgttcctagtaacctatcaattatgccggcagcagataatgatctgcattcaattattgacctatggcgtgatagttttgaagatgaagacaagcaaacaactaacttttattttatgaaatgttacagcaaagaaaatacatatctattaaaaaataacaacttccttgtttcaatgatgcaaatagtcccatataccattgttctggataatcaggagataaaggcatactttattcttggtgttgctactaataagaattatcaaaagcaaggaatgatgaaaaagttaatgaactatgtgcttaacttgccaaaatatgctggtcaaaaagttttacttcaagcttacatgccagaaatttattataattttggatttaataaagattattatcataaaattacaaatgttgacaaaaaatcatatcaaaatgattatgatttaacagttattgaagatctggattttgtaaattcacttaaattatataatgatttcacaaaagattttaatggttatcgtaaaagagatatcgactattaccaaaattacttaatcgcacgttgccgtgcttataatgatcgaataaaattattttatgataatgctaaaataattggatatgcaatttatcatgaaagtgcttctaaaattgaggtcagtgaaataatctatactaattatgaaagtctaaataaaatcgtttgtttcttatcaaaaacaaacaaagaactgattattgaaagtgatttaaacaatgaaataattggtgattgtacgtatatatgtacaatgttgaccaattttttaaaaaatagttgtcaagataataaattttatataaatgagtgcctataatacctattttttattgactaacctatctctgcattataaaatgtaaaagtatttaagaggaggttagttaatgttttcaaaagatcgagaattacatgaggaatgtggagtatttgcagtttgtggatatgaaaatgctgcagcaatgtgctactatggattacatagtttacaacaccgggggcaagaagctgctggtattgttgtaaaaaataaagaagctttgtcaattcaaaagggtgaagggctagttactgaagtatttgatcaagataaaattagcaaaatgaaaggtgatcatgctattggtcatgttcgttattcaacagctggtggtggtggaattgctaatgttcagccattattatttagaaccttaaatggatctttaggaattgcgcacaatggaaatattgttaatgccaatgtcttaaaggcggacttagaaaaaaaaggaagtattttttctagttcttcagatactgagattttaggtcatttaattatgcgtgaagaaggtcatatgattgatcgtatttgtaattccttaaacaaacttgatggtgcatttgcctttttgattttgattgagaatgctttgtatgtagcaagagataagtatggtttgcgacctgtttctattggtcaattgcctaatggggcatatgtattttcatcagaaacgtgtgcatttgaagttgttggtgcaaaatttgttcgtgatttagaacctggtgaaatcgttagagtcaaagacggtcaaatcaaatcaaagctttatacaaatgatgttactgataaaatatgtgcaatggaatatatttatttttcacgaccagatagtaatttagatggaataaatgttcatacaactagaaaacttgctggtaaacaattatttaaagaagcaccagtagaagctgatttagttattggtgttcctgattcttctatttctgctgcaatcggatatgcagaagcagctaatattccttatgaaatgggtctgattaagaataaatatgtaggtcgtacttttattcaacctactcaagaaatgagagagcagggggttcgaatgaaattatctgcagtttcttcaattgttaaaggaaaacgtgttgttatgattgatgattcaattgtacgtggaactacctctaaaagaattgtacgattgttaaaagaagctggtgctagagaagtgcatgtaagaattgcttcaccagcaatcaaatatccttgtttttatggtgttgatatgtcaaccatggacgaattaatttctaatcgtttgaatgttaatgaattatgcaattatattgaagctgattcacttgcctttattactgaagaaggaattgataaatctatccattttaataaagaaaaacataaatgtagtttatgtttagcttgtttcaatggtgaatatgtaacaaatttatatgattcatttgaaatggataaaatcaagaaaggtaaggaatattaaaaactccttacctcttataattattaaagtagatataacatatataacttcgcataatgtatattatgtaaattttataattaatttttaatagacaaacagaaataaattgatcgataaatcctaattaaaagcattccaataatcttagaatgcttttataaactataagttattaattaataccgttgtatttaaaaacaagaaaacaattcctaccactattaagtataagtataatttaatttgatgattttttttataattattatataatgctaaaataccgcaaattattaatatgcttgcaattatataaaataatattatgctaacggctgtcttggtcattaatcctgcagcaaagataaacgttccaattgcataagctaaaattgacatcacgatcaatcgttttgtattatcttccataaattctcctatttaattaattctaaaattgattggccaatagttggtaattcgataccaaaattatctgcaattgtagcaccaattacagcaaaagattccatatcatgtaaatgacgtggcttcaataattcctttgaataaataattaatggaacttgttcacgagtatgatcagtaccactataagttggatcattaccatgatcagcagtgatcattaataaatcatcatgatttaaatatttcattaattcctccaattgcttatcaaaatctacaattgcttgcccatagccctcaggattacgccgatgaccgtatactgcatcaaaatctacaagattaacaaaacacaatcctttaaattctgattttgcaagttcaacagttttttccattccatcctgattacttaccgtcttaactgctttagtaattccttgatcaacaaaaatatccggaattttcccaactccaataacatcaaactgtttatctttcaaattatcaagaacagtccgtccaaatggtgctaaggccaaatcatgacgattggcagtacgtttgaattcccctaccctttttcctacatatggtcgagcaataactctaccaactttccaacgctcatccatggctatttcacgagcaatttcgcatgctttatacaattcttctaacgggataatctcttcatttgcagctatttgaaaaactgaatcagctgaagtatatacgatccaatcacctgtttttatctgatgttcaccatactcatcaagaattgctgtaccacttgcagccttattgccaacacatttacgcccagttttttcttcaaaaagttcaataaattcttgaggaaagccggtttcggtaaatgtaataaatggtttttcagttttaagccccatcatttcccaatgaccggtcatagtatctttaccattagaaatctcgtttaaagctaaagtatatcctaattgtgaagttaattgatgtattccagaaaaattacccaaacttcctaatcctaatccttccaaatttggtaaatcaaggccattgcaggcattacatatatgttttaaagtatttgatccttcatcgttatataaattagcatcttttgcattaccaattcctaaggaatcacacacaattaaaaaaactctgttgtatttcatcttgtcctccattccttgcgtcactttttacgcaatcataagtatatcattaaattgtttccatatctagacattattttacccatcattatgcttttttatgcgtgggtggaattgctgatactcacttctaatcttttgattcgaaatatgtgtataaatagttgttgtactaatatcactgtggccaagcaattcttgaatagaacgcaaatcagcaccattttctaaaagatgagttgcaaacgtatgccgaaaagtatgaggcgagacttttttagttatagaagttgaatttacaattgtttgtaatatagaataaaattcttctctacttaatctttgaccatgcttattaaaaaataataaactatcattttttatattaaattcagctcgataatcatttatgtattgttccaatatctctccaacatatgaaccgattggaatcattctctctttgtttccttttccaataactttgataaatcccattttaatatttaaatctttcaaagtaagattcaacaattctgaaatacgcatacccgttgcatatagcaattcaaccatacatctatttctcgtactaattgcatcacaaacaatgatcccatcaagtatctctatcatttcttcttgagacaaaacaataggtaattttttatctcttttcggtaaggtaaaactactcatgagattttctttcacaatattttctttcactaaaaaaatatataacattcgtaaagaaacaagtttacgagaaattgaattagtacagtttgttttcgataactcctttaaataaagatgaatatgttctttattaatattttcaatttgattaatttcatattcctcaccgataaaattagaaaaagcaatcaaatctcgtagataagaataaatagtattcttactcaaacctttttcaacaatcaaatattgcttatattcacttaaggcatctttaattaacataaatttagcaagtactacacttactttcacctcaccttcacttaataattatatcacgtttaaatttaaccatactaacgatttgctaactaaagtgcataaaccttaaatgccattgataatgtgactattattaagataattattacgtaatctaagatataattaattatttttcgactattaaatacttctgttgtcaaaaatgaaattgtaaaacaatttattgataatctaatagaaattatagaaataatataagttaatgctaattcaataattaattgtggaaaaaaacctaaaaaaagcatagatgcatcaaacgtatttaaagtaaaataaaaaatacttgcaatcgataattgcattccttttgtaaaaataacaaaactattaaaaattgttcctaaaaaactagttgaaattattagagataaaaatatgtagaaactagtaattgtaatatatagattataattattggttgcctcattatctttgaaaaaaaagatatatttacataaatttaatagggcttcattaccataaaaataataaataatgccaaataagataccaaaaacaaataatattgcagaaaatatattaattaatactttttcatttctaaaaactttatttaaaatgctcataagttatcctccgtttatacaacttatgagcaaatcattattttattcttttattttaaatatttcttttggggagtcttttttgcaaatgatgaagctttagtcaccagcttcttatcaaatttattattgatagcatttagtaactgttcaagagaatcatcattggtttcatcctcttgcgccatttcaaaaatattaagttgttctttgtagttcttcttattgattgtattatttaaactgatgcctaaaagacgcacaggtcgaccgctataattagcatcaaataacatttttgcagtagataatatggtttcataatcattaataaatgaattgacagtagtttgtctagtaacactttcaaagcgagtatattttatagtaatcgagattgaatttgaaattaagttgcgcttattagctcgcgctgaaacttggcgagctaaactctttaatgtatcccttagtatttcctcatcatttgtatcatatggtaaagtagttgagtttcctacagactttaattcattttgtttagcatcaacagcgctattatcaattccattggctttacgatacaatagtagcgcatttttgccaataatttgtcttagtttattatagttatcataatttgcaatatcaccaattgtattaattcctactgctttaagctttggctgagtttttttaccaattccaaacatatccttaatatctaatggccacattatttcttttaaattagaccttgtaagtatagtaattcccattggttttttcatatcgcttgccatttttgctaaaaatttattcggtgcgattccaatagaacagcgtaaacttaaatgttcatatatatttttttgaatttctttagcaagtaatattggatgaatctgtttatctataattattttagttacatctacatagcattcatcaatactagcaacctctaaaatttcgctataagaagctactattgaaaaaaaatcattagataaacgatgatataattcaaaatcggcaggtaaaacaattaaatctttgcacaattctaatgcttgaaatagtggcattgcagagtgaatgccaaattcacgggcttcataagaagctgtggtaataatacttcgtcgtgatttaccagatataactattggttttccttttaagtcaggattacgtgatatttctgcacttgcgtaaaatgcattaagatcaatgtggaaaacaacttgcattactatacctcctttatgcaaaaatcacttgaatgcaaatcatatatgtaattgtgcctactaaaatcgataataaagtattttcctttaataaatgaattataatggtaattgaaacggcaattatttctggaaaaccatgatttccggaaataaaagttgtatcccttaaacaatatacaactaacattgccataattgaatatgttacttttaaaatcatttttcacaagtaaagaaaatgtttcatccgttaatgaaaaaatcatataaagttttaatttccctaaaaaattaaatttttttaacattgataatccataaactaaatgccttgcattaaccatcagtgtcataataaatgaactaataaaagaagcttgaccagctaataaagaaattgttacaaactgcatacttcccgcatatataaaacagctcataataaatgcataataaattggaaatcctttagaaacaagcaacattccaaaagcaaatcctaagactaaatatcccatcataacggggatactttctttaaatgcactttttatcgttaataaattcatcatgtttcccccttaactgtataattatactaaaaatctcaccaaattgaaataaaaaggtgctcaatttgagcacctttttatccttatttatccatctcaagcatccaatctatatatagaccatagccaataattggattattacctgatacatgagtcacacacccaactattttgttattttgaataatcggtgatccactcattccttgtacaattccattagctttattaattacttcttgatctgtcacagtaaattcaattcccttttcttttatagaatcctggtcattcaatttagtgatttcaatttcacacttctggattttatcaccatctaaaacagttaaaaagtaggcttttcctaatttagtttcttcaatagatgcagtttccatcatttctcgttttgaaatatcataattataagttccataaataccaaattgactatggctgtttatactacctatttcaatattggaaatgtctgcaattttatttcctgaagattgcgttgttgcttttttaatactagttactgtactttcaaaaatattaccattttgaataagctcttcgctgtcaagtttagagtcactcattgcatgtcctaaagctccaaaagtactagttgccgggttataaaatgtaagtgttccaaccccgctaattgcatctttgacatataatcccgtagaaaattgctgattttcataaacgacctggaggtcgtggtggagggtttctttacctcttttaatggttaaatcatatctgggattagctatatcgccttctttaataacattgcttaattcttcaatacttgttaccttttgattgttaattgcgacaataatatctccaactttaaaatcttttgctagtggatcgtagctttcattaccgactttgatcttatatcctcctgtaataaccacaccttgataatctagttcgattccaatggaatctccaccaggtactagagaaatagcatatattgcaattggattaataatggctaaagctaagataaaggaaaggattagctttttaaaaagcatagaaacctccttgtaacattcgttacatcatagtttggtttctatgcttttaattattcactacttatttttaatttttttgcatgatttattgattcctgagatacttcttttccagaaatcaatttagcaatttcattaatactttgatcataagataattctttaatctttacatttgtataattgtcattgcttgatttttggatcaaataatgatttttagcaaaagcggcaacttgtgctaaatgagtaatgcacaatacttgatgctgcttgctaatatatttcatctttgctccaatactttcagccactttaccactaacgccagtatcagcttcatcaaaaataattgtttccacagagctcgaagataaggacaatatcttgattgccaacataattctggacatttctccacctgaagctactttattcaacggttttaatgtttgtccagcatttgtagaaattaagaattctacattatcttgtccatttttttgaaaatcaactaatttaaaatcaaccttaaaaacaactttatctaaatataaagattttaattcttttgtaactaattcagtaaattctttagcttttgattgccttaatctagtaatttgctcagctactgatttggtctcttgataagcaatatccaattgtttttttaaatcattcaaatatgtttcccgattgttaaaagcagcaactttcatttctaaatcttctttagcttctttaatcgcctcaattgattgtccgtactttctttttaaacgatttaatttaaaaaagacttcttgaatttcatttaaacgatattcatcaaaattagtactattaaattcattgattatttcatcatcaagatcaattaaattataatataggtcatacatcctttcatacgtattttgatattgaggattatcgtttaattcttctaattcgcttaatgcattgcttaatgttgctagagcaccacgatcaccattcatatattgtcgatatttagaaatttgctcatttgttttctcataactttgaagcagttttttttcacgttctaactcatcttcatctaattcttcaagatcaagactattaatttcagctaattgagcttgataaaattctaattgctcatcactcagctcttcgtttaatgctttttgatagtcacgatttatttctctataagtacgatatgctagtgagtatgtctgaaataatttttttaaaggctgattaatgaactcatctaaaataattaaatgattttcagcatcaaaaagactatgggtttcaaattgtgaatgaatatcaattaaatcagccatgattgattgtaataccatttttgaaacattacgataattaattttaataatcgatttattatcacgattaaaagattttgaaacaactaatttatcttcataatcaatacgatattcttttaatttatttaagactggtgacttagcaccaattgtaaaaacaccctcaataaaacattcatcacaatcagctttaataaaacttgattgactacgatttcccattaattgaccaatcgcatcaataataattgattttcctgccccagtttctcccgtaagaacagtcatatgattatgaaaatcgacttcaagacggtcgataatagcaaaattttcaatatatatactctctaacattatctcacctaccctttaaaacaattatgtgctgtttctacaactctttctatgtcaatggcaacattattaccatctttaacaaaaagccctagaaactcgatattcccttcaccaccagttattggcgaataagttaacttttctaaaacaaagccatcatgatttgcatattcaataacatgttgaattactttttgatggacagatggttctttgactattccctttttcccaacttcttcacgtccagcttcaaactgcggtttgattagtgctacaacttgattaccactatgtaaaatattttttaatgcatcaaaaatatacttcaaagaaataaaagatacatcaattgaagcaaaagtaggaattccatgttcaaacagttcacttgttgcatatctaaaatttgtttgttcttttacaataacacgtggatcattgcgtaatttccaaactaattgattggttccaacatcaattgcataaactagttttacaccattctgtaaagcacaatcggtaaacccacctgttgaactgccgatatcgaccattattctatccgttatatctaattcaaactcctttaaggcacgttccagttttaagccaccacgtgacacatatggcattatgtttcctttaacatgaagatttgaatctattggaatttttgttcccggtttatcaataatatcataatcatcatgaacaatcccggccataatcgcgcgtttagctttttcacgagaatcaaaaaagccctgttcgactaataaaacatcaattctttccttcttcatttagtatctccttaactttttgataaaaagtatccatatctaaaccctcatcttgtaaaatttgtgcaactgttccttgaacagaatagtggtcatctactccaaaactatgaatccgttttaaaatattattttggctataataataagcaatattactagctaaagaaccagtttttaattctgtttcataaacaatcaacggtttttcatcaataatttcatttaacatatcttcatccataggtttaataaataaagcatcaataattctaacttttatctctttatctttaaaaaattcacgaatcaagttaacgttttgaccataacaaataattgttacatcgtaatcttttcgatttacaacttgccatttaccaatagttaaaagctcatcacctacattcatatcttcaatatcgcctcgagggattcttaaaatgtaaggatgatcgttattctttaaatatgtgttaataaagcgtttagcatcataactattacttggagtacaaattattacatttggcagaggtgttaatattcctaaatcaaaaacaccatgatgtgtaggtccgtctgctccaacaaatccacagcgatcaacacaaatcaagcagcccagatccattcttgcaatatcatgatttatttgatcatatgcacgttgtaaaaatgaagaatagatagaaataaatggctttttttgagaaattgctaaccctgctgtaaaagtcaaagcatgctcttcagcaattccaacatcaaaacttcgctcaggataatgcataaaaatattatccattgcagaaccatgaatcatggcaggggtaatagcaacaatatcctgatctgatttcatctgcctttcaatatgatcagcaaccatttttgaccaacttattttcgaactagttcccgcacctttcatagttccgtcttcaatattgaatggggcaatcccatgccatttaccggcaatatcattttcggcgtatttatagccacgcccttttttcgtaaccacgtgaactacaacactagtttttgcacttttagctaaatttaaaaccctaattagatcatcaaaatcatgaccatttaccggacccagataatcaaccccaaaatcttcaaaaattgtatcatcaatcaatccatgcttaacaaaatctttaactcgtttggaaacattaaaaatcatcttacctattttattgtgcgaagtaatattgcgataatcctcttttaaattattatatgtaccactaattcttattgaagataaaaaatcaccaaaaccaccaacacttttaccaattgccatttggttgtcatttaaaataataatcactttattattaattgagccaagatgatttaatgcttctaaagattcacccccaaccattgcagcatcgccaatcacaggtaaaatatgataattttcatgattcaagtctcttgctactgccattcccaaggccccgcttaatgcagttgaggaatgaccagcttcccaagggtcatgttcactttcacaacgcttttgaaagcctgaaagtcccttatattggcgtagtgtagaaaattgaccagcacgtcccgttaaaattttatgaacataagactggtgtcctacatcaaagaaaattttatctttaggggaattaaaaacataatggagtgcaatgctcaattctacaactcctaagttactcgaaagatgtcctcccgtttttgaaatattattaatcaaaaatttgcggatatcatcggctaattgattcaattgtctaatatccagctcttttaaaaaagagggatctgtaattttttctagatccattatttcactcttttctttaatttttccattatttctagaattaatccatgattaatctttaatttataaattaattccattgcttctttaaaatattgctcaacaatcatttgagattgttctactcccatcaaagttacatatgtagatttatgatttacttgatcactaccaactttttttcctaataaactactatcaccaactacatctaaaacatcatcttgaatttgaaaagctaaaccaatcttataaccgatttctacccatgttttttggtcatcgggattagcaattaacgctcccattttcatcgctgcactgattaagtctcctgttttatggtgatgaatcaaatctaactgatcacgagtagccaatttagtttcgtattccatatccaatgcttgccctaaaatcattccgttaataccgctggcttgatataaagttgctaacaacgagatttttaattcatcaggaacttttgttttaataattacattaacagcttcattcaataatgcatcgccagctaaaatggcagttgcttcatcaaattgtttatgacaagttagtcgcccacgtcttaaatcatcattatccatacctggtaaatcatcatgaatcaatgaatacgtatgtatcatctcaattgcacaagcaatatctagataatcttggtaatttttatcataactacgaatcacctgcagcatcattaccggacgaatcctttttccaccggccatcaaagaatatttcatggcttctttaactttagaatcgccaaattcctcaatgatttctaataatcgttcattaatttgttcaattaaattttccatgttattcctcgatttttagatcttctaactttccatccactaagatttttgctactttatcttcaattccagctaacttatcactacaaatctttgatagttttattccctcttgaaataaatctacacttttttcaagtgatatttggttattttcgagagccgcaataatttcttctaagcgactcattgcttgttcaaatgttatattgtccataaattaacctctattctataatggcctttttaatgccattatgtaattttaattcaattttatcaccactatttaaatcatcaactgatgaaataacatgatcttcttttaaaacaattgcataaccacgttctaatgttttaaggggtgataaagtatttaattttgataatgaataataaaacttttcttgattatgttgtaatttacgtttaatctcaagactcatcgttcgattaattgtatctaaacgatttcgctgatttagtgtaaataaattggcttgatgattaaaagtttgtattaaattgcttgctttgttttgtttttcaatcaaatcatggttaaaaacattatttaattgatcatataaataatcaattttagccgtcttatcttcaaacattttttgaggatttttaaataaatagaatgactttaatcgatttaaattttctttatttaatataattttttgtttcattaaattatttaaagtatattttatattgtctacagcctgctgtaattcaaataagtccggtgttgctttaattgccgcagccgttggtgttgcagcacgataatctgcaacaaaatcacaaatagtaaaatcaacttcatgaccaacaccgctaataataggtgtcttacattgataaattgctcgagctaatccttcctcgttgaagttccataagtcttctaatgaacctccgcctcttgcaataataatttcactaaatcctagtgtatcaacatatctaagtgttctaattatttccaaatatgcatccttaccctggactggaattggaaatacgattacacgaacgacaggaaaacgcaagtgaatggttctaataatatcagcaagagcagcactaggataggctgacaaaactgcaatcttactaggaaatttaggaattactaatttattttcagggttaaataaaccttcgctagctaactgcttttttaattgttcatattttaaaaataaatttcctaatccatcttgttcaattgtatcaacatacaattgataggtgcctgctacatcatatactgacacactagcttgaacaagtactttcatcccattggtcaaatcaaaaggaactttactagcttttgaagagaacattactgcatttattcttgaatgctcatcttttagcgtaaaataaaaatgtcctgaactatgatgtttaaaattagaaacctcacctttgattaagattcgctgtaattgactatcagaatcaattttagcttttaaataacgattaagtgcactaaccgtcagatatcgtttttccactatttaatcctattaagtaatccattaatgaatttataagcatcactatcacaatatttttttgataattcaaccgcttcattaatgattacttctttactttgttcagtttctaaaagttcataacatccaactaataaaattgcaagttccatttttgataatctatctaacgtccatccgggttttaaatatttagcaacttcagctttataacgttcaatgttactagcaatacttataataaacataaaacaataatcaaaatcatcttgattgctagataaatccttatcactgtttaaatattcacgaatctcatcttcatttgtatctactagcagtttttgataagttgcaattactgctttttctctaattattttttttctatattttttcatctaatccgtccttccaaaatatctatcatgattttaccatatttgcactttaaaataaacgaaatgcatcataataaaacaaaaaagattatccgaagataaccttaaaaattaattcctttaacttcaatatttactttaacatttttgattcctgtcatttcaaaacagctttgagctattttattttgtaaggcactagtcactgatgcaacattcaatccataatcaattagtacatcaacatcaataattacttggttatttttattaatatttgttctaactggcccacttccaggcattgggatcatatttccttcaaattgaacaccatcaactgactcaactgcttttacaactatagcttgaaaaacgctcaaaccaatatttaaagctcctaaattagattctttttctactgaataatattcttgactcatattaaatgctcctttatatactcccattgtatataaatttaagataaaattcaagtctcactgataaacttgacttcaacttgatactcatttttagtcttttccataactgttttaataatactgttagcatcactactacttgcttcctttttatcaataactactttaatcgttttattctcaacctcaacaaatgcattcttaaaaccagcatcattaattatctttgtaatttttgcttctaaagcagcagtttctttagcttcactaatattagccaaagcagcagcgattttattactatcgctatcacttgatgcaataattgcattattttcactaattaaatctgctctttctttttctaaattttgttgtaatacttcaatttgcgataattcttcattattaacagatacttcactggcttcaccttcaggtggtagaagaatatagtaaattgaaagtaccaaaattagactaaatagggttaaaaaagtaatggcttgtctattcatattatttctccttttatcaactactttaatatatgctaaaagttaaaatatatgaaaaaaaaacactagttaaactagtgttaagctcttccttgatattttccatcaactgtattaacaatgacaacttcaccttcagaaataaataaaggtactttaatttgaaatccagtttcgataattgcattttttgttgccccagtagctgtatcaccttttactgctggttcagtttctgtaatagtgaaaggtacattaattggtaaagatacccctaatacttctccttcataactagttacttcaacttcatcactttcttttaagaaattcatttcccattctaagtttccagcaggaatttcgatttgttcgtaagtttcattatccatgaaaactaaagcatctcctgaattatataaatattgcattttacgtttatcgatatgtgctttttttactttatcatttccaccaaaagtaatttcagtagttgctccagaacgcatatttttcattttaactttgatatttgcagccgcacgagctgttttattatgagaataatcaagcactacatataagttaccttcatattcaaaagtaattcctggtcttaaatctccaacactaatcattttaaaatctccttacttgtaatttactttgtgattatatcaaaaatcatcgataaagtgaagtgattttagtaactattgataatcaaacgatgatattactagcgtttcgatattaatctccaaattaaaactgtatgatgaatcattttgtttgattgttgtaacaatataatagtaactccccatatcatccactgtataattaatgaaataatcatcaatacttatttcatcactaaaaagaagatcatttaaaattgtttctttataatatctcagtattgttatttccaacaaacgtgccctatctaattctctgattcgttctagactgcggctattctctattatattattaaaaacaagacttatgtttaagattaaaacaataaaaataactaacacgacttgaagaatcgtaccccgattattacaatactgtttcaacttcatctttttcattctcacttatttgataatcagtagcaataagataaacatgttctttattatcgactattattttcatataaatattcttatttttttgataaaaatttaattcatcaacattgtgtgtaatgatatcaaaacctggctcttttactatcctatgatgatttagtgaaatagtaaagatttcgttatttgcatttgtgtaagttaaatcatcattgatttcaatatccttagccgtatgcaaaattgatgaaatttgtttaactccaagagcataactagaaagattaaaggataatttatcttttgcagtaactattcttaaaatggggacactgtttaaaataattaataaacatattgataaagaaaaaagaacttcaatcaatgtaaaacctcgttgactgattcgctcaaaccacttgtctgccacagttctacctccttttcttgttgctgttttaaatagttcatataatcctgattaatctgataatgatgatttattgcattattataacaagaaagaaacaatactataatactgataaaaatagaaaaagccatcaatgtttcaattaatgtcatcccttgcttatttaacataaaatgctccacttccaacatttaaaattatacttttacatccatttgaactacaaatctttagatgaccacccgaactgatatttccattatgattaaagtgaaactcataataatcgtcaatataatagttgtcgttaatcgtaagagttcgttgatccttttgtccattataactaatttgttttgtttgaataactatatttatttgctcgtggttgatcatagctctactttttccttcttctaacaatgaaattacctgttgacattgctgctgtaaagaaattactggttttgaattaattacaaaatgaagtgtaattgtacttaaaattaagattatactaattgtaaagacaacttcaatcagagtgaatccgctatcatcgtacatatgcttgtccatcactgattgaaatcctaagtccgcttggacatgttgcctgcttttctgtcaaatatggatgttctccagaagtcaaatcactaatacttgttggaagttctccgttttcaatttcgtataaaactatttgtgaattaactacttctatttgcgcatcacaactcttttctttaacaacccgattcttactagttacattaggaataacaagtaacaaaataactaaaattactgaaatacaaaaaatcatctcaatcaatgtaaagccattattccttttcatctttcatacctcctataaattactgactacattcatcatcggaataacaattgcaacataaactaaaattacaaaaccagccacaaaacaatatattattggtacaaagagtttaatcaatctcgttacctgcatatgcaaagtatcaatagatacccttaaataattatcgagtgatttatctttttgattatcatgaattaataatttaaaatatgctataaataatggttcaaaatattcaaaatcatttattatatcctctaaagcttctccttctaaaacttgtcgataaatttcgtaaattatcattttaatatcactatcatctatttgctcataaagcatgacaataatatcagttgaatcatagccattgatcagtaattcattatagtacagagcaaattttagtgaatagtatttttggattaaccttcttattaaaactattttttcaattaacaaatcaataagtttaaaatattttcttttaatagcataaatacttattgtgaaaaatactgtaaaactaagtataatgaaaattactataattggaataatttcaaaaagcttaaatataattctagttataatacttggactaatattaaattcgacaaacaattgcatgattgatggtaataatccatatacaataaacaatgaaaaaaacattaaaaaaataatgagtaaaactggatacgttaattctttttttagctgtgtaaatatttgttccttttttctgcatatttttaagctatgctcaattgcagttgaaatattatttttaaatcgaaaaaatttaaagtattcaataaatgtattgtcaaaatcaatttctataataacctcatcaaatgctttaccagcaaccaaattttgttcaatcagctttattttttcagtttgatggattatcagacataaatttaaaacatctttgattaaataaccttgttttaaaaagttagcgatattttctaataattgtaaatcatcattcataaataattcctgcaacctgtgtataatcaactaaattattttttaataaatattttgcattcatttcaaatgtttgatacttaacaggttcattattgaaaaaagttaaaattttttgacgatttaaatattctggtaaaattaagggctgatgtgtatacttgtgatagagcattttttggcatattatgccaattaaaacatcctctatatcaatttttaaaagtcctaagtttaaaagacgtctgattgttgtaaggcaatttgacgaatggattgttgttaatactaaatggcctgttaatgcacatgtaacagctagacgagcagtttgctcatcgcgtatttcacctatcattattacatcaggatcatggcgtaagatttgttttaaagagttattatatgtaattcctagtttttcgtttatttgaatttgcaagcaatactccttttttatttcgactggatcttcaagagtgacaatatttctttgttgagtagcgttaattgaatctagtagggtatatagtgtggttgactttcctgaaccagttgctccacttacaataaatagtccggcttctaaagtcgtgatatgttttaaaaaaacagttgtttctttaaaaatagtcaatttatcaaggacaatttgttgatgattgtttaaaattctaattacaatactatctaattctctaccaggtaaactagatattcgtaaatagtaaatttgattttgataaatataatttaaatgacccgtttgtggtcgtaaacgataattaatatctatatttgacttgaaacgaatataattaaataattttaatccgatatgactttcaaatgtatcatataataccaaatcaccatgttgccgaaaagaaacagaacatttttgcttcattaaaatatgaatatctgatgtcttataattaattgcatgatttaagattttttcaaatagttcatccataaaaatacctcctattatcatttacgcctgtaatatagaaattacttttaaaaaataaaaaaatacgattattctaaccttttaagcaaaacaaatctaaataaaatataaattggataatatatctagacacataaaaaatagggttattaatgaagacattacatcttccaaccctactttttgttaggcaccctacattattttaaagcgcctatattttatactcttatctagtactagaatctgcaagtaactatttttcaatttctatattctcattcgtagttcttcgattgtaaattttatactacagaggtatttccccatccgtttacgaaagaggttactctagcacaacagttacttgtatgttgtgcaattgttacatcatcatacccgctagatattttacttccagatgcgactacaaaagcgacatgattgtatcgtccatctttttcccaatctgctatacattgatatattgatttttttatttcttctagtgatattttcattgatcttaaaaatacaataagtttcacactatcagcatcgctttgactataatttcggtagtcattatcatctctatctggttttattaaaccaactttttcataatatatgagtgctttcttggtaatatgaaaccactcttcaacttcatggtcttcatagcattcattctccttgcgcttattacatattatgccctaaggtttaggtcaataaaaaggataatatttattcacaaaataaatatgaatcttattctattagtccacaaaataaaaaagtgaaaggaatgataatccggacgttttccccactatactttaaagagattatggattatcttcataatctctcattataatttatagcgggttttgtaatccctctctataaattatagcatcttttttctcgttaactttaccataataaaaacccctcacgttggttatgtccaacttttggggttcgcttcaaaatatatagtcttttaatgtcctctatgagccttacaatagtattgaatagaaatacctaataatgatagtccagaaatgagtaacagtccatttatatcaacattatcaccagtttttacacttacaaccggttttgtcgtatctccaggatttactgttggctcatcctttacttctttaatatcccataaatagtcttttacaaatgttgtaaacagactacgccatgttccccagtcatgagcaccataagtttcaatataatcatatttaatgcctgcttcatctagatttgctaataatcctgcaaaatctttatttcctgtaaatccaactttaccataatcaacaataccagctgctaataataatgttggtttgtccgcattttttattgctgatatatcagtatttggatcagttgctgaccaaattcctaaatatccaaatttatctgctaaggtcgtataaatagacgttgttgtaagaccacccatagataatccacagaatgcacgatcattgctgatagttgaaacactatagttagcttcaataaatggaataatatgattcattaagttatttttaatttgatcgtagtcccaaccaaaatatgtattatccattgttacaacaattgcttcagctgcttctttatcagctaataaattattcattatatttggaaccgcaccaattgtcatccattcaacttcattaccaccgccaccgtgtgatacataaatagttttatagcttttagtagcatcatagttatatggtagatatatacctaatggttgttttgttccatcaatcgcatcataatttacgaatgaatatgttcctttttgattatcatctctagcataaacatattcttgtccatcaatagtattctttgaagaaccaacatacaccaaactgtggccagcatcatgattattgtagtcattttttagtgacggatttgctggatcttgaattgttactgtagtgccgtcagcataagtaactgtatagtcatagtagtaaagattccctggtaatggtaaagtaatttcaaaacgttcatcttttgtctctgtcaattcataaatggcagtatcattatttaacccatagccagtattaaacattccatctttatactcgtaagcattatatacttttgcttgtgaaaaatctaaagtctgagtatagtttttaaccgcttcatcatctttagaatagaattgtaaatttcctgaaacagttaccttgaccgcatccttgatatcttgatcttcgtatacaaaagttgttatataatcaccatcatatgctggattaatgttttcttctactgtcacaccggcttgataagtagattctccaggatattcataaccccataaaatatctttaacaaatgttgtaaatgcatctctccatacgccccagtcatgtgaaccgtattttaaatcataaaaatgctctactcccagctcttctaaatattcatgtgctcttactgtcttccctctgttaaatgctgaatctccagattcctgcgtcgcctgaatagccatatctagattcccgccagttagatatactgtctttgtttttaataactcccagtctttacaaatcagtggatctgctgtccctgaaaaatttccatacgctccaaacatgtctgtataactgaacatgattgtccctgttgtcaatgctcccattgatagaccacacagcgctctgtcctccactttcgtagatacgctgtatctctcttcaatcagcggaatgatattttctttgaaatttttcgcaattaaatcataatcccatccaaagtgactgttatccattgttacaacaacactttctgctgcttctttttccgcaaggatattatccataatatttggcaatgaaccaatttccatccattcggcttcatttccgccaccgccatgtgatacataaatcgttttatatgtttttgaaggatcatagttgtatggtagataaacacctaatgactgtgtttcttcatctgtgttatgtgcatccttgtattcaataaattcatatttccctgtttgaccgtcagctcttggataaatatactcctgtcctgctgttgtattttcactgtttccaacatagaaaacactgtgtcccgaatcatgatcagttaagctgtttttctttgatggatttaccggatcctgaatcgtaacttttgaaccgtcactatactctactgtataatcataaaaatactgattgcccggtaacggcagtgtaatctcgaatctttcgtctcctgtttcctccagttcataaatgggtgtatcgttattttgtccgccgcttacattgaacattgcgttatccttatcatagtcataagcactgtaaaccttggctccggtaggatcagctgttttttcataatttttaacaaccggatcatttaatgagtaaaactgaaaattacctgaaactgttactctttctgcgtcacgtgcatctttgtcttcataaacaaaggttgcggtataatcggcatcccagtctggattagtatttttctctaccgttacgcccggactatatacagcattttgagccgttaatgcggtaataccattggacattagcatagttcctgataatgccactgacaataacaaattctttttattcatattatcccttcctttcactaacattctatccgaagaaggaataagaacgccacattcctttatgcaagctgctttcattttttgcaagcaggttttataatttgaaagagcatgcgggcagaaaagttaatatattcattaattatataagctagtagaatatcaagttgcaatatatttacactaagataattatatcatgactcattttttattatttcaaccatgagattctttcctaaaataaactcacagcgatcaacacgcattattgtaaaatactacaataattgaattattaaaaaaatcgtaaaaaattatagcgaaccgaataagttgtccaacctattcggttcactttttatatgtccaaacttacgaataaacaaagaatagtggtactatgtcacatatgggtttatatgcacttaatcctactcctaagcaacgttataactcttataagggggaaatgaatggaacttgtaagaacttacttcttgataaacgagagaataagtatattagaaaaacatattttaatagaaaccttaaaactacatcggttaatcaaaaatggacaactgatgtttctgattttaaaacagctatgagtaaattatatttatctccaattttagatatgcatagtagaaaaatcgtaggatacgatatatcaactacaccaagtctatttcaaacataccgaatgttagatatggctttctctaaatttttccatagtaatcaaggatggcagtaccaacatttctcatattaaaataaattaaaagaaaaaggaattacttaatcaaagtctcgaaagggaacggtcaggataatttactaatagaaaacttcttggaaaaaatgaagaatgaaatgttttatggatttgaagatacattcaaatcattagaagagttaaaacaagctatgatagattatatcgaataccataataattctataattacagtaaaaagaaaaggcttaacccctatacaaattaggaatcaagccttacagttaatttaaattattttttgtccaacaaaggcagttcactataaaaattacgacttttttaaatatggattatttaggcgttcttcacttaacgtagagtttggtccatgaccaggataaataacagcatcaaaatcatattcctttattttatttatgctttcgattgtttcatactttgatgaatttggaaaatcaaagcgtccaattgaccctttaaacaatacatctccagaaaaaattatattttcatcttttaaataaatcattgacgatcctggacaatgtcctggtaaatgtagccattgtacatcaaaatccccaaacttcatctcctcatggcttgactgaactggtgctttaacagtaaaaggattttcatacactgataaatttaactgaggattatctagcatttctaaatcgtcttgatgaagatagataggacagtggtaatgttcgtataaatagtcaaccgcaccaatatgatcgaaatgtccatgagttaataaaacagcttctggaactagttcattttccgtcaaataatgcacaactttcttaccattagctccaggatcaatgattaagcaatgatgattctcatcacttaccacatagccattagtttgcatattacctagcagtaatgtttttattttcatcttcttcctcctataaagaaaaaaagccaataaggcttatttcttttctttatgtacagtttttttattacatcttggacagtatttgttgatttccattctatctggatgatttcttttattttttgtgttgatatagttttcttcaccacattcagtacatttataaatgatattttctctcattagttacacctccattagtaaacttccgtctaatatattatcatagtatttaaataattactagcactttttttaatttgttgagtgatacttctcccagtaacgatcaattactgcttgagcaacgatcggagcagaactagatccgcttgttgcagtagtttgtcgataactcatacaagcaaaagcaacttctggtctagaatcctccgttgtttgcacataacctatttgtaaatgattaggataatcggttgttccagtcttaccatcatcagttgtataatcttctgctgttccggttttagcataagttacatatggttttgaattccaagaatgtgcagttccttcagttcgggtaacacaagctctcattccttgtttaatttggctaaacgccgtcgcttgattactaacatcatctaatacatttgtatttgcctcataattaacttgtatttctccatcctcatcagtagtatatgagtctaaaagtaagtggggctggattcttttcccgccattagccaatgtacatgcgtattgtgctaattgaatatttgtgtaagtatcatactgaccaatcattgcatctaataacaacccacctgtacgttgttttcctcgatatcctaatgcttcatttgaaacatctaatcctgttttaactcctaaccctaactcacctaaatcatttcttaaagtatcaaaagcttcttcatttattttcaacggcccatcataaacataatttgccccacctaaaagcattgctatcctaaacatataaacatttgatgaataagccagagcatcaacttcattaatagttccaaaagatttccaagactttttagcttttgttcctttaattttgattggctcatcaacaaaataagtgtttggtccaattactccttctttgaaaccagtataaattgaacctcccttaattgttgaaccgattttatttgcatctaggtaattccctgaagcataatcactaacttcaccagttgctttatcgattgttttgccggccattacaataatttcacccgtatatggatccattagaataaaaaacattttattaaaatatttattactgctattacaagcttttaattcctcttcgattttttgattagctaattgttgaagttcccaatcaattgaaatacgaatatttgaacctgcagttcctgctttagtacttgttattattgggtttcctgagctatcataatttaaggtataggtactatcattccctcgtaaaatatcttcatactgctcctctaagcccgaagttcctactctagaatcattttggtatcccaatgctaataattcattttttaattctacaggtaacccttgttttttagtcgtcactttgcctaaaactgaagcaaactctgttgaatttgaatattgacgtgcccaatctgttgtaactgtcaccccgggtaagatatctgcattttcaccaataatactagcctcctcatcagttaaaccttcagccaaaattgacgaaccactcgtacaattttgcatcaagtataaaaagtgagtatattttaatgttgcttcatccatatattgactaattaattcatcagtaattctctctaatttaagactatataatcttttgtctgcattttcttgagctttgatttcttctttttctttatcgctaatcaatccgtcagcaacatctttaaaagctaaaataaaataatccttttttgctcgatcagaaatgatttttttatcatttacatcaatattgatattttttgctaaaaaagcagctgattcttttaaaacatcattatcaatttttttaggtgcataatatgttgcacaaattacacttgtattttccactaattttacatattcacggtcaacaatttctcctctaggagcatcactcgtatatgtagtagtaccatattgttccagctttactgccaattcatcagcctgtttaaattgtataattcctaaacgtattgccattacggaagtaacagcaataacaaaacaaagtagtccgattaatcgccgactaacaatgttatcttgtaaatttttttgttcacgttcttgttctgacgccccataaaaacgtaccttaggtattttatttcgaaaattaaatgccatttctacgcctccttatcatttgttcattataaaacaaatttacttgtaagtaaattaaaaacaaaatttaccacaaagtaaaaataactgccataattttattaaaatattttatgacaaaataggttttaaaaattaaaatatcattgattaaagacaaaacatgttactaatttcctaataataaaaaatattaatacaacaattagagatatcatcctattcgttattaattataaactataataattagatagtacattaaaatattattaataaaaaataaaggaagtgattactcacttcctactcgaattcattattcttcgctacttctcttatccagttagcactcttcttttcaattctcttgtatccctgatctaatgctacacgaatgaatccgtaacgatttttaaaagcatttgcccatgaccagttgtctattactccccagtaatgatatcctaaacagtttgatccatcttctattgcttttgcaatccattccagatgatcccttacaaattctattcgataatcatcctgtaccgatccattttcatccatatatttttcttctccttctacccccattccattttctgatatgaaataaggcagatccggacattcatttttaatcttcatcccaaaatcatagattcctttcggataaatctcccagccacggtgttcgttcattcttctctctggccagatatatggtttcgctatacatggcaatccattttcatcaaatttctgatctggtgcctgaattcttgtcggctggtaataattaaatcccaaccaatctacttttcctccagctaagattgcttcatctccagggcgacgattcattttgatcttccattcattttctactgtatcaattacatcctttggcagatgtccgtgtgctactacatctaaccaccagcggttatgcaacccgtctgtcattcttactgcttccagatcctctggacttggatcttcttttgtatatggtggtgcaaagcagttgatcatccctatcttcgctccttcaaccattttccctctagcctgcagttctctaaagttcattactgctagacagtgtgctaatgtgatattatattggacatccaatgaacgtttaatgttcttttcatagggaaaccaaaccccatgcaaatattgctgttctggttcaacgattggctcattgaatgtaaaccaatatttaactttgccaccaaattcctccattgcctttttaacaaaatttgcataagcttcaacaacttcacgattagcccaaccaccacgtttatataaatattcaggcatatcgaaatgatacatgttcataaagatatcgattccgttttcattggcacaatcgatcagtttatgataccatgcagctccttctggattaatatttccatcctgatcaagcagtctagtccactgcattgatgttctaaaagatttaaagttcattgatttgaacagttttatgtcttcttcataacggtgatacatatcatttccgacatatgagccaacattgttatgaaaagcattgatttcctggtcagaccacatgtcccagtatgatcttaggcgaccaccaacgttataagcaccttcagtttgcggaccagataaagccgccccaaagaaaaaattgtctggtaatttgattgtcattttcattctcctttattcgtatatatttatattgtaatggctatcaagactatttacaacaaaaaaataagtaggatagataatttatcctactcatcgtcaacagataatatcgccatgaatgcctcttgtggaatttcaacatttccaactgccttcattcgttttttaccttctttttgtttctctagtaatttctttttacgagaaatatcgccgccataacattttgccaatacatttttacgcatcgccttaattgtagtacgggcaattattttcccttgtagtgctgcttgaattggcacttcaaacatttgttttggaataatttcttttaatttttcacagataatttttcctcgtccatatgcaaaatccttatgcacaattgttgaaagtgcatcaacgacttctccgttcaataaaatatccattttttgaagtttgctagtacgatagccaatcaattcataatcaagagatgcatagcctttagtacctgattttaatttgtcaaaaaaatcatatacaatttcagataaaggaatttcataaattacattacgtcgagtatcatcaatatattcaatatcctgatattctccacgtttagattgacataattccatgataacccctacgtattcgtttggagtcataatagaagctttaacataaggttcttcaatatgatcaattacttgcggctcaggcatcatcgctggattatcaacgattacttcactacgatctgtcaaatagcaatgataaataactgatggtgccgttgcaattaaatcaagatcaaattctctttctaaacgttcttgaataacatccatatgcaacaagcctaaaaaaccacatctaaatccaaatcctaatgcttgtgaggtttctggatcaaacattaatgatgaatcacttaatttcattttttctaacgcttcccgtaaatctttataacgagcgttatcaacaggatataaaccacaatataccatcggatttaattggcggtatccgggtaattgaatattagactcattttcaactgtagttacagtatcccccacatgaatatcctggatggattttattgaagcggcaaaccagcctacttcacctaccactaactgttctttttttacttcacgaggagttcttacacctaattcagttacttcatatgttgctcctgttgccataaacttcacatgatctccaacgttaatagttccttctttaaccctaacaaatacaattactccgcgataactatcataataagaatcaaaaatcaaagcttgtgttggattattcacatctccactaggagcaggaaattcctgtacaactttttcaagaacttcttcaacatttaaaccgctctttgctgaaatcaacggtgcatgatctgccggcaaaccaataacttcttcaacttcacgtataactcgttgcgggtcagcacttggcaaatcgattttattaataactggcaatatttctaaattattatctagagccaaatacacatttgccaacgtttgtgcttcaactccctgcactgaatcaacaactaatattgcaccttcacaagcagccaacgatctcgatacctcataagtaaagtcgacatggcctggtgtatcaattaaatgtaacaaatatgtttgaccatctttagcagtataattcagttgaactgcgtttaatttgatggtaattcctctttctcgctctaaatccatactatcgagtaactgtgccttcatttcacgatctgcgacagctccagttatttgcaaaattcgatctgctagggtgcttttaccatgatcgatatgtgcgataattgaaaaatttctaattttactttgatcaatagtcattttttcacccactttcgttaaatcattataacaaataagccggttaaactcaaatgatatttaatcatagtttttgaaatatttatctaataaagaaactcgttctgcaattacttcaattgaagtaatttgttttgactcggcacattctaatgttctcgaatgcagtcttcctttaactgcaatcatgcatcctggtcttgcacaatcaataatcatttcagcgataccgcgccataaacttacaacaatgtaatcattttcaaatgcaccaagactatttttaaaaccttgttcgatttgaatagttgcatttgctacttttacacctccaatcgttgttttcatttccgggatatctactaatctccctactaatgctacagtatttaacattatttacccctcctttatgacaaaattataggcataattataaaaagattacaacactgtaaaattaaccataattaacgacattgtcaaaatgggtcactggtgaaactttttctttcagatgtgtagcaaaagttaacagatatgcttaaatagactatatcagtctataaaaaattgtcgaaaaaaatatacatattttgcaaaaaaagtccatcttatccctgtttcgcccaaaataactactatatttatttttatataatatttttcaatacctccaataacaaaaaaaactctataaaaatagagtttaatattcccaaattaagattcattttttattattcccaccccatcataatgaggacaatataaaaaagatattttcttatactttcttaaacacagaaataaatatatttttgattatgctccattatagtaccttaactcatcttgcttgtacatactttatctttagaattccaatttattttgctagagttcaattaatattaaattgggctaaatatttagttaacatcttatctaaacaaaactaattattgtaatacttgtatctattttttccgccttcttttgcttgatacaacgctttatctgcttttaaatataaagtattcatatctctaccatcaataggtgctagtgctattccaatagaagcttggatgtttatctgatccttttcactttgataatacaaatctaattgttgaagaagtctggatattaaacgattaaaaagcttgatgtcttgaatattttttacaaaaaccacaaattcatctcctccaaaacgtgaaataatagcatcatcacaaaatgaatttttcaaaacatttgctacatcaactaatgcttgatcaccagctaaatgtcctaaagaatcgttaagatttttaaaattatctagatcaattaataaaaaaaccgcctgctgtccttgaggtacttcttgtaaatattcattaatatgtgttttacaataatatcgattatatagtccagttaactcatctgtatttgcttttagctttaatctttctatttgctctttttcactttgatttaataaatattgttctgtggtatctgcaaccatcattaatatgatttttgtatcttcatcataaatataatagtgtattgttttttggtgaaattctccacaactatccaaaattcgtatattacaaaaatagtcgccatctttttgcaaagttaaaaaaatataatcgagattcattttagtttgagctactttgcgatcttctataaccacctgactttcaataaatgtatctaaggcatctttataatcaaattcattttcattaaaaattagttccttcattccttcagtaacaaattgtaaatatttgccactatcgcaatcaatataacagagcgattcaaaattcttttgtacatattttgtaattaccgtttgaaatacatcgtctttatcgatttttttaattagaattaaaatacggtcttctaatgctttaggaaccattaaatggatccgataccagccataaagaaaatgctctgttttttcacggatatcgatatgtgcattctttttttgaaaaacaagttcttttaaatggttaaatgataaaaaactattaagatattctaattcagaaatgtcactgcatctctgcataaataaagataaaaatttgttataagacatatcatgaattgataaattttcacctttaatagcagatatgttttgtgtcattatatctatatcaaaaatataagcattttcctcgataatcgttgagagtattgcatcactatcaataaaaaactccatatttcgtttttgttcttgaatgtccataattcccattaaaactttaggactatagttcatttgtgctagtacaaaaacaagtcgtatccatgaatacccatcattactattatgaatacgaacatcaatcgtcactttttgtttttttgctgaagataattcattataagtttcacaaatgataagatgatccatagaataaatatatttttttataaattcaaaaaaattaattcccgaaaatatggataaatatttatcttttcgttgaaaaacaatctccatcgtattcgtaaccggatcaatttcacataattcatcgtatatatccatataatagcgtgaatattctttaaataaaagttgatcttgaatttgataatcaaatgagaatggttcgaaacggaaaattaaattactaatatcttgatgatacccttccaatcgataacattgtgtaaaattagtattgagatacccgccacatcgtatatacatccagccattttcaggatgtttccaaggatattcgacttctgccttattcccacttattaaacgttcaactgcttcctctacataagaaacataagctggatgtattcgttctacccaaaattgataaacttcctccggcgaataagaatccgctactcctaacagtaatttcatatgagtattaccaaacattttagggtcattctttttattatgagacaattcaataacccaaattccaattttagcattttccagcatattatctattaataaattttccattaaaattctcccaattaaaattatttattaaacttatttagcatcttgcttgtaaaatcatttgaatcaataggacgactataatagtatccctgtccataatcacaaccaatttctttaaccaataaatcatcttcacttgtttctactccttcaataacagaaaagatagaaagtttcttagatagttgaacaatttcctccattattaaacgtgcattttgatttctagtatcctttatctcaactaaaaagctacgatccagttttaattcatcaatatttaattttcctaaagtatttaatgaagaatatcctgttccaaagtcatccatagatattttaaaaccaatatctcttaattctgttaattttttatttaagtcatctacattttcgattgcaatttcttccagaatttctaaagtaattaatgatgctggaatattatatctatctaatattccacaaagattctttacgtatccaatttcataaagtactaattttgattgattaattgcaatcggaatagcttgatatccttcgtcaatccattggcgaagcaattggcaaaccttttcaaccatatacatatctaaattaacacaaaatccattctgttcaaaaattgggataaattgtgagggaaaaattgtagtcccatcgtttcttatccaacgtaccaaggcttcagcactagcaagagaattagtttttaaatctatttttggctgtaaatacaatttaaactcaccgttttctatggcttcgtacatatgcctttcgatatagtcattcattttttcttgctcatgtaaagccgcatcgaaaaaccacagcggtattttaaaattatttttcgatatttctaaggcaaacattgcatgtgtcattgacacttgtagttcctgcttgtctgtagctgttgcaataccacaactcatagtaattctataattactattagaatcattcgatgacgttctgattttttctaaaatttctttaagacgaacttcaagaatgtttttttcagtctctaataaaaacatataaaaaacatcagcactatcacgacagacaagttcaccatctttgatattatcatttaaaattcttccaatgtagcacagtaacctatctgcttgttcttttccaaaaatctcatttataaatttaaatttacgtacatttagtgcagcaattgcatattcagaatgttcttcaatatgctggtgtgccaattccccaaaacgatttaaattataaattcctgttagacgatctaaatatgcaaaatccattaattgctggttattctttttcattgtccgataaccataaattaaaagataacctactagtaacactataatgacaaagaaacaagctactgcataagcaaccgagtaaatcccactattactattttgaacagagttaatacaaaacaaataccattcattaacatcaagcggttctaaaattgaatgatactcttttccttcataggtaaatgtaaaacggactatttcagaatttttcatactttttttaatttttgttaattcatctccagacaaatacggttctttaaatatatcagtctttttttctttaacaactgcatgtgaggaacgaatcaaaaatttcccattcacatccaataaatggatataagcactcccatttaagaccttttcgccatctataatttctgaaaatatatcaacaacactactagcaatcatagctccaacaatttgtttatttcgatatactggaacgccaaaagtaaaaacctcttcttcggaaaaatcaccatagaatggttctgaaacattttcctttccccgcaaagctttacgaacaacttcttgtacttcaggctgtagcgacgataaatgaatatcactagaaataatatgatcacctgtagatagtgttcccatttcatcattgtaaaaaaaagcaactgtcaagaaatcattttcaatatatgccctttccaaaatggaatcaaaatcagcagactcatccaaattagaatttccaataatgcttgcgacggtatttaacatttgaaaattattattaatttgtttatctaatctctttttataattatctgtttcttcaatcattctttcatcggttgaacgatcaaaagctgttcttatcacatagaaaaatccagctccaattgatgctaaaaatatcccaataatgactgcaaaaataattatttttctaagacttttcttaactttatcttcatacatgattttcgcttcctatcacaaacttgaaattttacgtatgttattataccaaaaaatgaaattataacaactgttgaaaataaaaatatacctcatttaatattgcaatatttttattgtatcttgtatataattattgcccaattacaagtaactcataaaagaatcatataccaactatataataattttataaaatcttcaaaactaattttacaaatatcttattattgctctaatctataattatctaataaatttaccaatatatactgaaaaagaaggcaatttagccttcttctacaacaacatatgcaattgcataatcattttcatgagcgattgaaataaaagtattaggataattaatttttggcttgccgtttttatcatttaatatctcaatatcatgaaaagacagcatgccatgttcaatcccatgagccttaaaaaaagcttctttggcagcaaaacgtccacccaaaaattcttttttttgttttaaagaatttttatttttaaaaattaaaaattcattttttgttaatagttttaaaacaaaacattcattatctaaattcagccgatttagatcaacaatatcacaaccaataccacttatcattgttagtctttaaacttcttttcatacaaactcattaattcatccaatgacatatcatcatcaatttcatcaatcaaagagttttgtttttcaacatcgttagtaccaaaatctaatttgaactcaccagttcgctcctcaataattttaagctgatcctgttcttcttccacaattttagctatattacgtaaattatcttctactgtaggcaaatcttcaataacttttttttctttaggttcatcattaatagttgtcagttttgcttctgattcaacttgttccttttcctcataatttccaaaaaaaggactaattacaggaactaattgatcaacatttttacgttttttaggttttgaagaagttgttggctttacagcttttttatcattttttccttttgtaattcccatcattggtgaaataacttcactcatttggtaaatttgacgaggtttttcttctaccttaggctttgcctcaacaaccttagttttttctttagtctttggggtaggcgttacagtcacttctggctcctctttaaattcttcatcatatattaatggcgtgctaaatttttccttacgtcgctgttcaacgacaggatccacttcaaaaatatcttcatcttcttcatgctttttaaataagcctctaaacatcactgtttcccccttttctagaaaaatgaatctccaatactatatttatctttatctaaaactaatatacctctaatttggggagcattaggcagtcctaactctcttgctgaacaaatcatcccgttagaatcaattttacgtagttttgaaggtttaataaccaatccactaggcataactgcgccaatagtagctactaccactctttgcccaacttcaacattaggggcaccacatacaatttgtgtagtagtattctttaaatcaacctgacaaatatgtaagtggtcagaatctggatgttcttccattgcagttacttcaccaacaataaaacgaggttctttgtctaagacaaccggatcaagtccgtgagttgttaaaagttcattaaatttttcaatttgattatctgaaaaattaactagtccagtatttaattctcccaaataattactagcattcaacaaattaaaaccaagtatcctatttttactatctttcaatacgactaaatcatcatatttatcataatcaaaggtcctaccttctccacatcgtgctaataaaatatcaccaacatgttttaaattataaaatccatgaaatatcattcctacacctcttattttaacgtatcaataaacgcctgtatttcttctttagtcttacgtaacttacttacaaagcgtccactttcttctttatcgttataagctacaaaagaaggaatacctaaaatatcctgatccttacacaaatcaatcatattgtcacgattaatcatataaaacttgtattcaggattggcatcaacaatatcgccaatgaacggttttacaaacatacagtcaggacaccagtctgctgtaaacattataatcgttttacctacacgaatattgtcaaattcttcgattgttttaatttctactaatttatccatttttacgataccttgctaccaatttataaattggccctttctcacaaaatttccgctcatactcagtcataatattgatttcactttcaggactgttatgcaaatctaaactaatgtactctatatccattggatattggtttaaagaaataatcgaatattcgaacagtccacgattatcacttttaaattcaatatttccttcatctattaaaatatccttgtatacatctaaaaatttacttgatgtaagtcgtcttttagcatgcttacttttaggccaaggatcactaaaattcaagaatattttatcaacttcatctttttcaaatacttgatgcaattcaattgcatcgtaatgcattaaacgcaaattatttactttttcttcacgagcatttatcttatttattgctgctgctaaaacacttgggtatttttcaataccaacaaaatttatttctggaaattgacgagcattttcataaataaaatcacctttacccatcccgatttcaatatatattggatgattatttccaaaaatatctttccatttatttttacaattttccggctccaatattacaaaagatttattttctttcataatatcatatgcttttggattatttcttaaacgcattattactcccctttacatataaaaatattctatcataaatcctccatcaagtcgactaattcctcattagataattctcgaaaatcacccaatgctaaactcctatccagttcaagattgcggatcgataagcgttttaaatatattacctctttaccacaaacctcaaccatcttttttacttgatgaaactttccttcaaatatttcaattctaacatcacaactatcattgtttttattaataatttctaggttggcaggtttacagtgatagccagtatttaaaataatcccatctttaaatgcctgaatatcttgttcatccataactcccgcaatatttgcaaaatatatttttgaatgatttcgactaggggctaataatttatgactaaaatcaccatcattagtaattaacaatagtccttctgtatctaaatccaagcggccgacaggaaataaatcataattttcatagccctcaatcagttctaatactgtaggatgaagattgtctttagttgcactaatatatcccgctggcttattcagcattatatagacatatggccggtattcaatcaactcatcatcaaatactatttcatcaatttcatgatcaactttaaaatcatctttctttataatcattccatttacttttacaaaaccttttcgaatcagtgattttacttcttttctagtaccaatcccatagtttgcaagcaatttatcaagtcgcattaccatatagtttaatatacctttcttctttgttattagattgtttatctgttgaaaaagtcaaataaaccaatacactaaattcacttttactagtaataccagatagatttacacccttataaattccattggctttatctactacttcaggaactaatgaaaaaatatcttcctcaagaattcctaaggttggtagactttcattatcatcaccagcaacttttgctattgcttgtaaatgatacatatttattgtcggtgtgtcaataataacatcataccgatattttttatcttcaactttattgactactaaacgtatattaaattcatttgtagcattcaaaaattcattatgattatctattttattttcatattctttatattgtcgataaaatttattatcgttattgtctttatttttgcaccctattaaaactaggcaacaaattagaatcaaagctatttttttcatttttatcaccttttttattatatcacgtttttatatgtatacaaaaaataaaacatataaatgtctttttgtaaagctcatacttataacaaaagacatcacaaaagttacttcttaccttttgtgatgtcatattaaactttctatttacatttaaaagtttcacaagctgtttcttgaatatctttcgcttcgtgacatttacaattacaaactgtaatttcttttgcctcacaattacaatcatgattgtaaacacaagtatcaacgtgacaacatacacctttagccatggaatcacctccataaatagttttaactaaaatactaaaagtatgcgaaaagaaaaggataaatatgattatttatcctcgtactcaatcaaacagctaaaactatattctaattcacttgaaaaagtcattgccacttgataatgcagcgataaaattttaggatttttcttttccaaaaaatcattaatttcatcttctaaatctaactcgtgtgttttttcaataatttttactttcataagataattataaaatttatcttattccttttttgtcattattggttgatttcaactttaaaagtacattcaaaaatctcactaggatttagactaactacaccctctttatccttaaattccccagtgaaaccaacataatcactatgacctacccaaggttcaatggcaattagtccacccacatgtttagctgcccaaatacctaagtgattaaaaccttccatatggaatactaaagatttattgtgatttaatgacttcaatgataatgtttttgatttcacgtcctttaaaacaattgcatcattatcaaataattgctgacgaacaaaaaatctcttttcgttatctaaaaacggtaatgttatatctgacattcctttatgttcaacatcaataattttttgattaacagtctcattctcactaaattctaaatagtaatcattacttgattcattttccataaaaggacaagcaaatgcaggatgaccaccaatttggaaataaatagtctgactatcggtattagtaactttacaattacagctaagtacattcttatccaatttataagttacatctaacttaaataaatatggatattgtttagctatttcctcatttgaaataagtgtaaaaactacttcttgatcattaatttgattagcctcatattcactatgacgtgaaaaaccatgttgagtcatagtataagttttaccatcaattcgacactcattattttgtagcgcacctacaataggaaataggattggagcactattcgcccattgaattggatcacgacgccacatataattaatttgatcatcctgcccaacaattttaataatttctgcacctttattagctagagtaacctctaaaacttcattctttaatgtaatcatactatcctccaatttttacatttccatcaatcattacaaaatcaacattaatttcttcatcaaacataataatgtccgctgttttgttaactgcaatttcccctaaatcaattaaattcaaatttttagcaggattataactagctaaattaacagcttcattaattgataaacctaaatgttgatatgcattctttactgcattattcattgctaaaatactaccagctaaagtcccatcttctaaacgagctgaattatctttaacaaatacagcttgattacctaatttatattgaccatcttctaaaccagaagcttcaatagaatcagtgattaaaatcactttatctaaacctttagcccttaaaagcacttttgcagctggatagctgacatgaattccatctaaaatcaattccgcataaacttcatcatgttccatgatagctcctactactcctggatttcgatgtgttaatggtgtcattgcattataagtatgagtacctgaagttgctccagctttaattccaacaactgcttcgtcataagttgcattagtgtgcccaatacttacaaccacaccttctttgactaaatactcgattaacttatcagaatcctttaattctggtgctaaacttaatttttttacaattttaccatattcaccaactaaactgctataattttcagctgtaggtttgatcataaactcttcaggttgagctcctttatattttgtattaaaaaatggaccttccatgtgtactcctaggattttacttcctccaactttatccatgttatctccaacatttttaatagccgcataagtatcttctttagacatcgtcatcgttgtaggtaaaattcctgttacacctgtttttacggcagtacttgtaattgtatcaagatcttcaaaagtgttatacattgtatcactgccaccacgcccatgagtatgaacatcaataaatcctggtgacacatatctaccttttgcatcaattactgtttcatcatcaggttgacgattagaaatctcagtaatctttgtattttctacatatacatttgcatctactacttgattttttaaaataactttcccgtttgttatacagtatttcatttcttttagtcctcctatatctatatagtattatagcacaattctatctagatgaaacaaataagactcaaataaaaagaaggtgatttattgtagtcccattatttaggtatttcaaatggtggagttcattttattatggttaaactcacaagataacaaaaaaatattgtgtataaaaaatttttgaaaagaataaattccacagtcaatattaaaaaagaaattgtttagataattcaccaatgaagaattccgttggaaaaatgaaattttttatggttatgaatatacttttagatcgttatataatttaaagattgcaatagaagaatgtataaaacaatactatactcaaaaaataacaacaaaattaaaaggatcaactcctgtacaatacaggatcaatccttattaatagcataactaaattagtgtccaagaaattgacttcacttcaatttgaccttcttttgaattatttatcatgatgatttaaatcatcaataattttttcgattttattaccatactctaaagaggtatcgttaacaaaaatcagttctggtactttacgaattgtaagacgtttagctaataaagaacgaataaatcctttagaacgatttaatgcttccattcctttgcgcgtatcaaagtcttttcctaagaaagtcacatatactttagcaattgatagatcagtagtcatatcaactgcagtaatagtacaaaaacctatcttaggatcacgtacttcaacttgaatgatttgtgataactcgcgttgaataataccattcatcttatcctttttaagaatcatttaattcacctacttaacttcgacttcttccatgatatatccttcgacaatatcgccttctttaatatcattgaagttttcaatacttaaaccacattcaaatcccgctgcaacttctttagcatcatcctggaaacgttttaatgaacctaattttccttcatatacaacaacactatcacgaagtaaacggattccacaattacggcgaataaaaccatctgttacataacatccagcaatatttccaactttagaaactttaattacctgacgaatttctgcttgacctgtaacaacctctttaatttctggagcaagcatacctttcattgcggtttcaatctcttcaaccattttatagatgatattgtgtaaacgaatctcaattccttcttcttcagccttttgacgtacttttgcatttggacgaacattaaaaccataaataattgcttgtgaagcagatgctaatagaacatcagattctgaaattcctccagctgtagaacgaataacatttactcttacaccatcaacatcaattttttctaatgaagctttaactgcttcagcagtaccttggacatcagctttaacaataatgtttaagtcaatcatttcgccctctttgatttgagagtataaatcatctaatgataaggcagctcctgaactacgctctttatcttgtttcgcttttaatcgtgtttcaccaacactacgagcttgtttttcgttttcaaaagccataaacttatcaccagcgactggaacgtcatttaaacccgtaatttcaactggagtagcgggaagtgcttctttaataatttttccacgatcatcaagcatttgacgaacacgtccaaatgatgttccaactacaattggatctcccgctcttaaagtaccattttcaacaagtaacgttgcaactggtccacgccccttatctagtttaccttcaactacactgccatatgcataacgattaggatttgcttttaaatctgctaattctgcaacaacagttaaagtttctagcaattcttcaattccaattctttttttagcagaaatttcacagtatactgtatctccaccccaatcttcaggaagcagaccatgctcagccatttctcctttgattctttcaggatcggcaccttctttatcaattttattaatcgcaacgacaattggtacacctgctgcttttgcatgatcaattgcctcttttgtttgtggcataacaccatcatcagctgctactacaataataacaatatcagttacttgagctccacgagcacgcatagcagtaaatgcttcatggcccggtgtatctaagaaagtaactttttttccattaacttcaacttgataagcaccgatatgttgtgtaatcccaccaaattcaccttctacaaccgcagactttctgattgtatctaacaatgtagttttaccatgatcaacatgtcccataattgtaactactggacaacgaggctgtaaatccttctcatcatcctgaatatcaatttcctcaaaattcacttcactaacttcaacatgtttttcgacttcaaaaccatattcaagacaaattaattctacttgctcatcatttaaagatgaattaatagttaccatcgttcctaatagaaacaatactttaataacattggcaggcgtttgtccaattttatcagctaattgaccaacagtaataccttcttcataaacaatgacaccatctttagcaactatttcttcttttttggtcggaaaattagactttaattgtttctttcttggcgcaccttttttattttttgtttgtttattttgttttgccatatgttcaccctcctatcttttcttttaatattttagcaaatccagtatcctggataccaagtgctactcgattttttttaccgattgcactggatagttcatcaatagtacaagctataacatactcaactttataacttgtacatttatcggtgatcttttttttagtattgtcactagcgtcgctagcaataataacaaattctacttcgttacttctaatctttgtgattaaagtttcaccagtaacgatttttcgagctcgcgcagccaagccaagtgtatttaaataattattcatccgcaaatttttccagttctacgaaaatttcttcaggaatttcaacctgcaaagcccgagctaaaacttttttcttttttgctaacacgaacgcttcatgactacgtttcagataagctcctcgtccattcatcttaccagttggatcgacagctacttgaccttctttattacgtacgattctgattaattgttgttttggcaactgttcacccgttgccaaacattttcttaaagggatttttcgcaatttaatcactccttaatctttatcatagtattcatcatattcatcgtaatcgatttcttcatcatatttactatattcatcatctaaatcttcaaaatcttcgtattcaataacctttttcgattgagtaggttcttcttcaacctcaacaacttcttcttcgatttctggttcttctgcaacttcaacagcttcttccacaacagcttcctcaactgcttcatctaacatttcttgagcaaactcttcttcaaaactagcatcaacaggtgatgattcttctgtattattaactgtttgaagatcaattaaaccaagttcaacagcctcactaacagatttaatatcaatcttccaacctgttaaacgtactgctaaacgagcgttttgaccacgcttaccgatagctaaagataattgatcatctggtacaactactaaagcactgtgattttcttcattaatagatacccacttaacatcagatggactcaaggcattagaaataaagacaaccggatcactattccataaaataatatcaatcatctcaccatttaactcatcaactacatttttaactcgacttccctttggtccaacacaagagccaattggatcaatattttcattactagtataaacagcaaccttacttctttcacctggttcccgtgaaactgctttgatttcaactgttccatcgtatacttcaggtacttctaattcaaataatctcttaacaaaacttggctctgtccggctaacaacaatatgagttcctttagttccacgatcaacatcgctaacatacacttttaaatgttgaccctcatttaatttttcaccaggaatttgttgattagaagctaagaaagctcctgttttaccaatatttacaattgcaaatttatcctcaacacgatcaacgatacctgtgatgatatcatcttttttatctgcaaattcgttataaagtgtttctttttcagtttcgcgaatcttttgtctaaataattgttttgtttgaatagctgccaaacgtccaatatgttcgatatcggcttcggtttcaacaacatctccaatttgataattaggattgattgcttgagcttcttctagagataattcaatatcttcatcatctagatcatcaacaactgttcgaagttcaaataatctaaactttccagttttttcattaatttcaacacggacattagcatcagggtttaaataatttttcttatatgctttaccaatagattctttaagcatttctaaaaagacatctttttcaatccctttttcttcaattaataaatttagtgcatccatgaattttttacttgccacttttttatcctcctaaaatttcacagctagtcttataaatttaatattgctatagtcaattttaattcttttcttaatattcttaactaaatattcaaattcaatcgtttcatcttcaattgttttaataaatccttccacttcatccattccagcagttggattaatgaatttagcgtagacatacttacctactgaagctttaacttgctcaaaagtctttaggggcttttctacacctggtgaagaaacttctaaataatattctcctttgatcggatcttcttcatccatctttaaactaattgcttcactaactgctacacatgtgtccatgtctagggaaccttcatttttttcaacaaaaatgcgaagataccattcgccattttcctgaaggtattcaatatcatcaagatatacatcattattttctaaaattggttttatcagtgttttaatcgtatctaaaagttccattctttcacctctattcaataataaagagtgggtcaccccactcgcttctctatgaaactaaataaataataccacatttttttaattattgcaactacttagaaaagtgaaagttgattacgctcctgcattccattaaaaacccccattttagatagtgttttaatatgtgaattgttcaactttgttcgtttaataacatcttctttagataaaaacggaccatctgctcgagcatctacaactgttttagctactgattcacctaatgcatcaattgcactaaacggtggaatcaaccctttttcatcgtttggatctaatataaacttgctagcttgtgaatactctaaactaactggattaaaatggaatccccgctcaatcatttctagtgcgatttcaaaaatatcccataatccttcatctttgtttgaagaactccgttcagctcttaactgcgttatttcagctcgtcttgccatgatagcatctttaccttgtacaagtgtttcaatatcataaaaatcacatcttgttgtaaaataaacagcataatattctcgtggataatataatttccaccaagctactcgaattgcagataatacataggcagcagcatgagccttagggaacatgtatttaatttttttacaagaatcaatataccactgcggtacattgtattctttcattagttcttcatattttttttctgggaaaactaccggtgacttacctttacggacacattccatgatatcgaaagcatccttgtttggcaaacctttttcaatcaaataaaccataatatcatcacgacatccaattacttcagaaagtgtacaagtcccagatttaattaacgtttcagcatttcctaaatatacatcagttccatgtgatagccccgagataataactaaatcattaaatgttttaggttgggtttgatctaacattccacgtacaaatgaggtaccaaattcaggaagccctaaagctccatttttgcaaccaataaaatcaagattacatcctaatgcctcactgctagtaaacaaactcataacttttttatcgttagttggaatatccttaggatcaacacctgtcagatcttgcaaaaatcgtgttacagtcggatcgacatggcctaaaatatcaaatttcaaaacattatcatgaatagcatggaaatcgaagtgagttgttttccacgcagcatttagatcatctgccggaaattgatacggtgtaaaatcaaatacatccatatcccctggaataacgatgatcccaccaggatgctgtcctgttgttcttttaacaccaccacagccggctgcgattcgctctaattcagcagaacgaattgtttgatcagtccccattaattcagcatatccttttgcatatccataagctgttttttctgctactgtcgaaatcgttcctgctctaaaaacatgatcttcaccaaatatttctttagtaaaagcatgtgcattagcttgatattcacctgagaaatttaaatcaatgtccggtactttatcagcgttaaatccaaggaaggtctcaaatggaatattatgtccttcacccttcattattttaccgcatttagggcacactttatcttccaaatcatagccatcagccacaattccttcttctaaaaattcgctatgcgaacaatggaggcatacatagtggggcggtaacggatttacctctgttattcctgacattgttgcaacaaatgaagaaccaacagatccccgagaacctactagatagccatcatcatttgatttttttactaatagatgagaaatatagtaaatgaccccaaagccatgcttgatgatattactaagttctttttcaaggcgcttttcaacaatttgcggtaacggattaccatatgtcttatgcgcagtatcgtaacaaatcttctttagattttcgtctgcaccatctatcttaggcgtgaacaatttatcatgcactggtttgatttcctcaaccatatcagcaattttatttgtatttgtaacaacatattcaaatacttcgtcttgtggtaaataaggataaccttctaacatttcattagttgttctcaaatattggcagggatttttagccttaggattgcgtcgatcacacagcggatgagcacggtgaccaattccaatcgtcggattagagataaaaacatctctaaaaattttatcacgaacttctaaaaagtgaacatcaccagttgctacaattaatttatctagtttttttgcacaatcaataatccgatgtaaagatttgattaactcatcagtatcttgcaattttccacgatcaactaagtgatagtagtcctcaagtggttgaatttcaatatagtcataaaattccatggcccgttctaatttttcatcagataagttcagagccgcctcaaaaacatcaccgttatagcaactgctgccatataataagccttctcgataatgttctaaacgttctttaggaattcttgatccattatgaaaatatttagtatttgcttcactaaccaatttaaacatattttttaaaccagctttatttaacgccaatgcggtcatatgataaggataaacaattttataaacatcatcccctgttaattcacacaagtctaaaagattatatttaccgctttgcataatttgatgtaacatcatgttaaaaacatcacctaatacttcagcatcataatcagcacggtgagccacttcatcatcataatttactcgataactgcggcacacattccccaatcgatacgatttcatcggtttcaaaattgctcgtgctaaagccaatgaatcgataattgggttcgtaatttcaggcatattatttcgccgtaaattctcatttaaaaatccaatatcaaaattagcattatgagcgactaaaatacaatcatcaaaaaattctataattctaggcaataatgcatcaatcgtcggttcattacgtaccatatcattagtaatgctagttaaattagtgattcttgaggaaatgctcttccctggattcacaaacatttgcagtcgatcaattacttctccatttttaattttgacagctccaaattctgtaatcccatcgtgaataactgatagacctgttgtttccaagtcaaaagaaacataggttgcatgttcaattgaggtatctatttcgttataaacaatattcaaaatcggttcgatcatattgaattcaacaccatagatcattttaattcctgcttttccagctgccatttgagcttcaggaaaagattggacattaccatgatcagttacagcaattgctttatgtccccagcttgctacagcgttaatatattgggtaattgttccaaccccatccatcgctgacatttttgaatgtgtatgtaattccactctttttgcttcactagtatctttacgtggtgctgggctcttaatcacttcaacctcgcgagccatcataactgtttcgcgtgcaaagctatcaaaacgggcttcacctcgaacttttacccaaactccgcctttaccgataacttttaattcttctaacgagttattagaattgttttcaaaacgtttaacaataattgaatcagtataatctgtaacccataaactttgaatatgttttcccgctcttgttttaatcatttctgttttaaaaacaaagccttttattacaatattattatccattgtctgattagtaatctcttcaattttcatatcgattgctgcatttttttgacgataattattcttataattattttgttctgacgccggtttatctggcttttggattaaagaaaggtcaatttcaactggttcataagcttccatctcttctttaatatctttaaatacatcgttttcttcatcaatataaaaatcaaaatttttatcgatacctacatcattgaacatatcttcaatttgtgctcttaactgacgtaattgttctaactgaatttcattacatgtttctactctaataactttatcttcgattttaaaactttcaactgttaaagtagcacaaacaggataatctttttttaatttttctaaaaggtatccggtatataataataattcattttgattaaaaaattcagtttcataactaattttatatttagtaggataaggaaaattatcgcggttatttattaataattgatactcctcaaatggcaaaatctgattaaacactaagtgaaaagtataactattatctctcgctacaacaactttactgatttttccttcttttaaaatattagcttggctttcaatctttaaattttttaataatattaataatttattttccatcaaatcatccttcattattcttatcaatataacactcaaacattatagcataaaaaaagggaaaattaattccctttatccaaatattctagaaatatcattaaaggttacaaagatcattagaccaaaaacaagggctaatccagcaatttgtaaaccatatttaacctttaacggtaattcacgcccgattactctttcaaccacagcaaagataacttgacaaccgtctaaaccaggaataggcaataaattgaacattccaatattagtcgataataaagctagcaatgttaataattgactaattgatcctgtttcagtaatttgagccgttacgttgtaaattcccgctggtcctgacaattgtccaattgtattagcggagtctgtaaatagcttacctaatgttgtaaaaatcaacagcgccatctctacaaatttagttactccataattaatagcttcaaaaaagcttaaatttcttgttgctggagtcaaacccattgtgtatgaattagaatcactattatattttgcattaacttctttagtaattgttttaccatcacggaccaattcaacttgtaacattattgtagcattttttgatttaagattatcattattcaacacttcacgaatgtctgcaaaagatgcaataatattttcatgaccatcataagtaattttagaaatagtatctcccgcctcaaggcctgcaatcattgcgggactgtccgaagtaactttcccgatttcaggtgtattagtttgaacatctattacacaataaacaccaattaaaattactaatgatagaacaaaattcataaagactccggctaaaaaaacaacacactttttccagcagctaatgccctttaaagtacgctcaattggaacatctttaaattcctcaatatcattatcagcctctccagccattgatacaaaaccaccaattggtaaagctctgatttcatattctgtctcaccttttttgcgcgaaaatatctttggtcccatcccaattgaaaattcactacaataaaccccaaacgatttagccgtaataaaatgtcctaactcatggatcagcacaacgattccaagaatcaaaataaaaacgacaatattaattaatgtctgcattaatcttctcctatctcttttaaaacaaagtttcgagcccaagcatcgatttcaatcaactgttcaagtgttggatttttgactaactgatgtttattcaatgctttctcaactaaattttcaatttcaagaaactcaattttaccatttctaaatagctcatttgcttgttcatttgcaccatttaacacacacggcatacttccaccacttttgccggcttgataagctaaagctaatgctctaaaacgttcaaaatctggctttttaaatgttaatgatgcaatctttgctaaatcaagactttcaccaccaattaaataatcacgttctggataagttaaagcatattgaattggtaaccgcatatctggattgcctaattgtccgataattgaagtatccacaaattcaaccatcgaatgaatgatgctttcaggatgaattaaaacttcaatttgatcataatccacgtcaaataaccattttgcttccattacttccaaccctttgttaaataaagttgcagaatcaattgtaattttagctcccattgaccaattcgggtgatttaatgcttctttaacagttacacctgctaattcatcacgttgcttatcacgaaagctgccaccactagcagttaaaataatcttcttaattttattgtgttcttcgccatttaatgattgaaaaatagcagagtgttcactatcaaccggtagaagtttgacgccatattcttttaccagttcagtaattatatgccccgctacgactaaagtttccttattcgccaaagctatatctttttttgctttaattgcttcaattgttgggactaaaccagcaaatccgacaattgcatttaatacaatctcaatctctggtaaagttgcaatttctatcaatccactttcaccataaacaactttaagatcaggatatttttcttgaagatataaagcatcttctttttttaccatacagatatactcaacatcaatcattgctaaaatttcctcaaccttagccacattataccctgctgccattgctgtaatcttaaactgttcaggatgattcattacaacatcaactgtctgcattccaattgatccagtaactcctaatactgtaatttttttcattttataacctcaccattactaaaaagaaactaaaaactattgcattaaataaaatactatcaatacgatctaatatgccaccatgtccaggtaataaattagagtaatcttttactccaaaatgacgtttcacagcactaaaaactagatcaccaatttgactagtgaaagttaaaacgaaaaatgctgcaattaaaatcacattattttctaacaaacctaaataactagcatacccaactgatagtaaagtcccaagcagcaccccaccgattgatccttctattgttttctttggagataatcgaggaatcaacttgtgtttaccaaaaaaaactcctgcaaaatatgcgcctgtatcactaccgtaagtagctaacgcaagcaataaaatatattgaaaaccatatacatcacgaagtgacattaaagcgtgtaaaccagcacatattagtacccccatcgtaaaaatataactagtgcgttcaattgtcaaggtatcatcaaaaattgttgctccaaataagacaatcaaatagattaagattccataagaagctaaaaataaatcatcctggtcaaataaaaaaccatagataaaaaatccacagacgattggatataaatacatttttatttttggacgagtgcatatatgtaacatctcatacactgccaatgctagaatcactccaatcaagcctttaaaataatatcccccaaatataacacaaggaacagcaaccagcatcaaacagattgccgtaataattctttctttcattattttaatcctccaaaacggcgatcacgattttggtacatccaaatcgctttatcaagttcattttcattaaaatcgggccataaaacatctgtaaaaataaattctgcatatgctaattgccataacaggaaattcgacaaacgttgttccccgctagttctaatcattaaatcaacttccggtagatccttagtcatcaactcatcattaaagacagtttcattaatttcatttacacctaattcaccagcttttactttcattgctagtttttttgttgcttctaaaatttcatcacgtccaccataaataaaagcaaaacataattttagaccagtattatttttagtcttatcaattgcagagttaataatatcttgagtttctttaggagccatttctaaatgtccgattgtacagatttttacattattttctatcagttctttcatatacaattcaaagaaatcttttggtaatttaaaaatatactgtacctcttgctctggtcgtgcaaaattttcggttgaaaaagcatatacagtcatagctttgactcctaacttattacaatgcaaagcaacatctcgaattgttttagtcccctcatgatgtccataagtgcgtggcatcttccttttttttgcccaacgaccatttccatccataataaaagctatatgttgaggaatattatctttatcaagaacatgataattaaattcttcattcttctttttcttaaaaagcatttgtcgtcctcctgtttaactattcgagattataccataaattcattacaaaaaaaagcctaagcaacattgctagacttaatcatcctagtacatataaattatttatttaatttactacattaaaataagaaaatatacaccttcataacgattatggtctttacagcttttttataattccagcacctgattgcctgttctaatgtctttcctttgttatttttaaagaaatcagaatatatgtattatattcaaattttttatcaattacagtttttgttgactcttttgcttctaaaatctcataatatgctttaattgcatcagatatattttaccagtgttcgtcttcaaccatttttgaaatgggacgttaaaagaaaaaagttttgtctattttttctttaaagaaaacacgatgtttttgtgaacaaacaaaattttcttcaattttactatcttctgttataattcctatttgacatttacttttattcgaactcatcaaatccgaaatattaccagtatctaaaaaataaccaattctctctgtaatttccactttaccaccactcataggtaatccattaactcgacaaaatgccacaggctcttctttcaaataatagtagctacgaaatatttcgctatctaaatttcaatccgaacatggtcttttatgcatatattttcttctttctaaataaattagataaaatgggcgtttaaaacgcccatctaattatacagtcatgatatctttttcttttacttttgcaatttcatcaatttctttaacaaatttatctgttaatttttgaactctttcttgaccagctttgatttcgtcttcactaccatcagttttcttaatttcatcattactgtcacggcgaatattgcgaattgacaccttagcattctccgcaaatttccaaacatttttagcaaattctttacgacgttcttcagttaaagcgggaaccataatacgaataatctcaccatcgttttgtggagtaagacctaaatccgcttcataaatgccatgttcaatatctttaatacttgatttgtcataaggtttaataactaattgacggccttctactaccgaaataccagcaatttgattcactggagttggtgaaccataatagttaaccattactcgatcaagcatattaggatttgcacgaccagttctaacagatgataaatcacgttggaaagattcaatcgtctttgtcattctttcatttgtatcatctaaaatcatatttatcattttattttcctcctgagattgttgttccgatatcatcgccattacatgctttagcaatgtttccgtctacagacatattaaatacacataaatcaatattattgtctttacataaagtgatagctgtttgatccatgatttttaaatctttttgtaatacatcaaaatacgaaatagtatcgaagcgaattgcattaggatcaacttttggatcagctgaataaactccgtctaccccgtttttagccattaggataacatctgcgttaatttctgcagctctcaaagcagctgttgtatctgttgtaaaaaaaggacttcctgttccagctccaaatattactactcgccccttttctaagtgacgaattgctcgtcttctaatatatggttcagcaacttgacgcatttcaatcgctgaaagaacacgagttggaacgccaatggcctccaatgcattttgaacagctaaaccattcattacagtagccagcattcccatatagtcagcacttgaacgatccattcccatatcagcaccagttttaccacgccataggttcccgccgccacaaacaattgcaatctcaactcctaaatctttggcatctttaatttgacgagcgatatctgctactgtatgagcgttgataccagttttatcatctccagccaatgcttcaccacttaatttcaataatacccgattatacttcatattaatctccttatttatattttataaaaaaagatttatgcttaaattcgcacatcattatcagctaataatgattactttttcctctaaaaaatttatcatattttcgtcgtttagtcaaggtacattcctagtcgaatgacgcttatccaaagaaaaaacactatctaatgatagtgttttaaaagttattattttgcgttcatttgagcagcaacttcttcagcaaagttttcttctttcttttcgataccttcaccaacttggaatctaaccatattgattactttaccttcacctaagaatttagctacagtttcatccggatttttaatgaattcttgatcaactaagcacatttcttttaagtttttatttaatctaccttcaaccattttttcaataatattttctggtttaggtttagcagctgctgcgttttcttccattgcttgagcttttaatacagataattcatgatctaaaacttcagcaggaattgcagttctatcaatatatttaggatcagaagcagcaacatgcatagccacgtcacgagccttatcttcagtagaattagcaactttaacaattgcagtcatttttccacccatatgagaataagcaccaaatacttcgtcagcagttttagttaaaacttcgaatcttctgaaacttaatttttctccaattttaccgctagcttcagcgataacagtttctaattttttaccatctacttcagtgtttaatgcagcttctaaatcaacaggtttattagcagcaacaacttcagcgatatttttaactaacccttggaattcagcgttcttagcaacgaagtcagtttctgagttaacttcaacaattgcagcagtatccccatctaatacgaaagcagttaaaccttcagcagcgatacgatcagcttttttagcagcttttgcgattcctttttctcttaaccagtcaaatgatttttcgatgtcaccatcacaagcttccaaagcttttttacaatccatcattccagcaccagttttttcacgtaattcttttactaaacttgcagtaattgccattttaattttctcctttatttgtttttttattaaaaagggaaaagctttgctttcccttattttacagaattattttccttcagttccagctgtgttatctttatttggtctaggagcattatttcttctaggattaggtcttccacctttatttctaggtgctcttctttgattattttcaactgaagtgattgcatcgttcatagatacttctttatcatcttcatctttaacatatgctacagttaatggttcatttttagcttcacaaattgcatcagccattgcagcaacaattaattttactgctctaattgcatcatcattagctgggattacataatcaacttcatcaggatcacagttagtatcaacgataccgaatacagggatacctaagattttagcttctgctacagcattatgttcagctttaggatctactacgaataaagcatttggtaatcttctcatttctttgataccacctaagttcttttctaacttagcagcttcttttttaagtaagattacttcttttttaggcaataaatcaaaagtaccatcagcttccattttttctaattcaattaatcttctaattcttttttgaattgttttgaagtttgttaaagttcctcctaaccaacgagagttaacatagaaactttctgaacgaatagcttcttctttaacagcttcttgagcttgttttttagtaccaacaaataatacttttccacctttagcagcgatttcattcattgctttataagcatcatcgatttttttagatgatttttgcaaatcaataatataaatcccgtttcttgatgtgaaaatgtatggagccatttttggattccatctttttgtttgatgtccaaaatgaacacctacttctaataattttttcattgaaattactgacattgtaacttcctccttttgttttttcctccattatttcgaacatttatcaccttacggcactagataaatgaattcataatgtgtgtatttttcatacctgaaacattttatcatagatttttcaatcatacaagcatatttttcatcattttaacttgaattattcaatatttcgtggatgtgcttttaaatatacctcttttaaatgatctcttgaaatatgtgtataaatttgagtggttgataagttttcatgacctaacaactcctgaacagttctaatatctgctcctgcatttaataaatgtgtagcaaaggaatgtcgaattgtatgaggatgaatttttttggttgaatcataaagtcgcattattcgatctactatgttttctactcctcggttagttagaggattaccgaatttattaacaaagacgaaattatgcccctcattttttatcattaaattttcacgagcttcttgtatgtatttaatcaaccattctccagcataatcatgaaatggaacataacgatctttattcccttttccatgaataaataataccatttgattaaaatctatatttgaaagttgtaaatttacaacctctgaacaccgcaagcctgatgcatacattaattccatcatcgctttattacgaattcccagatcatcttttgtttcaatactatctaatagtcctaggatttcttcaggaaaaagaaaatccggattacgctttgcaactttttgggattcaatcagcaaaaaaggattatcatttattaactcttcttttaataaatagttaaaaaaacttcttaacgcactgagtttatgattaattgttgttttagaaagatttttttcatatagcttagtaagatatccacgtagcattgcataactcacatcattataatcatcaatagattcttcaataagaaattgtttgaaatgatcgatctgacgcttatacgattctattgttttatcagcatagtgacgctgatattgtaaataatcaagatattgtcggaaatagttatccaaggttgttttcatcaacaaatcccttcattgtttccaacgctcttgatgcataagcagctttacgttcttttttcttgattcgtattggaaaatctggcaaaattccaaaattagctttcattggttgaaaatcttctttcgaggcattagttatataattagccaacgctcccataacagtattctccggaaaaatcaaaggctctttatcttctaataaccggaccatgtttattccggcagccataccactttgagcagattctacatatccttctactccagtaatttgacctgccataaatatattagaataattttttaactggtatgtctttaatagatgttttggtgaacaaataaaactatttcgatgcattactccatatcgaacaaaacttgcattttcaagtcctggaatcatttgaataattcttttttgttcaggccaagttagatgtgtttgaaaaccaacaatgttatataaacttgcttggacattgtcttgtcttaactgcacaacagcataagggcgcgtcccatccggcgcagtaagtccaactggtttcatcggtccaaataacaacgtttgttttccacggcgagccatttcttcaaaaggcatacagccttcaaaaaatttttcttcaaaatctttaggtttaacaacttccgcattgactagggcatcataaaaagcattgaattgtgcttcattcataggacaattaatatattcattatcccctttattgtagcgagatttataatacgcaattgcaaaattaatgctttcttttgcaatgattggtgctgctgcatcaaaaaaataaaaataatcttcccctaacttttctttaattgctgttgcaagagcatcacttgtcaaaggaccagatgcgataattgtgtaacctgcaggaaattcttttgcctcttcatgaattacttcaatcaagggatgactctgaatgtactccgttatcgcttgagaaaaattattacggtcaactgcaagtgctcctcccgctgggacttgatgttttctagcatatttaataatgagactatccatcatttccatctctgcctttaaaacaccgaccgcatttccagtcccatcagcacgaagtgaattagagcaaaccagttctgcaaaattaccgctatgatgagctggggtcatctttttaggacgcatttcatacagtcgaactttatatcctctttttactaattgatgacaggcttccacaccagccagacctgctccaattacatttacaattttttccattttatcaccttttctaattttatcatttctattttgaaaacaaaagtagaactttcgttctactttatgattgtcttacatttcgggtaatttgaacaagctttgaactcaccccaacgtccttgtttgattacaatcggagaaccgcagtttggacactcttcatccgtcataacaggttcttttttcttgctgtttttaatatacttacactcaggataatttgaacatgcttcaaaacgtccaaaacgaccatttttaaaaatcatcttacttccacacttaggacattcttcacccgtatattcaatctctacagggtctttctttacatatttgcattctggataattttcgcaggcaacaaaagttccataacgtcctttacgttcaactagatcatgtccacattcaggacatttttctccagttttcttcggtgcaatcacttccattttatcatatgcattatcaagcaacggttgaaataaatctaagaacttttgtaaagcgtgagcatattcatcttgcccttcagcaatatcatcaagctcatgttccattttcgctgtatattcaacattgataatatcattaaaatattctgttaatcgatcacttgtcaagattccagattctgtcggtttgaaagctttatcaaccaattcaacatattgacgagtttgaattgtatcaataatcattgcataagtactaggacgaccaattcccagttcctccatctctttaattaattttgcttcactataacgagctggtggtttagtaaaatgttgagttttttcaatgtttttacttaataacatttctttttctttaagctccggcaaaatttcattactttgtttttcataatcgccgtaaactcttaggtacccatcaaatttgattactgaaccactagtcttaaactcataaccattattcatcaatgatactgaagttgcatcaaattttgctggagccatcaatgaagccattgctcgagcgtaaattaatgaatacaattttaactcttctggctttaaatattcttttacactttccggcgttcttaatgcactcgtaggacgaatcccttcgtgagcgtcttgaacattttcttttttctttcctacttttacttttccaatatactctttaccatatttttcaccaatataatcttgagctgcactgacaaaggtatctgataaacgagttgagtcagtacgcatataagtaattaatccgactgtctcattttctaaagtaatcccttcataaagcttttgagcaattgacattgttcttctcgctttaaaacctaatttagaagatgcttcttgttgtaaagtcgaagtaataaaaggtggttttgattcacgccgtttagtcgtttttttgacactagcgatttcaaattctttatttaaagcttcataaattgcagtagcttcttcaccattttttatctcaatcttcttattattatatttagctagttcaccactaaattcaattttgtctttctcaaattctgcttttattttccaatattcttcgggaacaaaagcttcaatctcacgttctctttcaacaatcaatcttaacgcaacagactgaacacgacctgcacttttagatttgatctttttttgtagcagttttgaaagtttgaatccaataatccgatctaaaacccttcttgtttcttgagacttaactaaattttggtcaattttacgaggatgacttagtgcatcaactactgcatcctttgtaacctcattgaaaacaacacgattttctttatccatatcgacatttaatacttgagctaaatgccatgaaattgcttctccttcgcggtcagggtcagttgctagataaacatcatctgattcttttacaagttgttttaattccttaacaacatcttttttgtctttatttataacatatttaggttcgaattgattttcaatatcaacacctaacccttcttttcctgaagttgccaaatcccgaacatgtccttttgacgaagtgactacataatcactccctaaatatttttcaattgttttggattttgatggcgactcgacaataactaattttttgctcatttcatttcctccacgcgattaacacaattattagtgttttttaaagttttgtcaactaaattttttaaaactgtttttatccattaagaatgtcgctcacatttataactaatttagcaccctgttgaattaaataattgcaacccaaagcatcgttgatacggctaggaacacaatatatatcttttccctgttctagaccgtgcccgactgtgatcatcgtaccactttgctgatttgcttcagttactaatatagattcactcaatcctgaaattatgcgatttcttcttggaaaatttattttttgtggtataaattttcccggatactcactgataactaaatgatgatcttttaaaacctgatacagctgttgatttctgtgtggatagcaataatcaataccacttcctaaaacagctattgtttgaccattagctgtaattgtactttgatgtgcaatcgtatcgattcccattgccataccgcttataattgtgtaacctgcttcaaccaactgtgctgctagtgctgctgtgcattctacgccatatgtactaggatgtcgcttcccaattacactaatacatttatttttaaccaaagctaagttaccataataaaataaaacgaatggcggacaggcaatctctttcaaagcagttggataatctggcgagatcaaagtagtgtaattggctgtaatatctttaaacaattcttttttcaatttttcatctatcttttctttacactctaaagcttttaaaatcgaatcaaaatcacctgcatattttaatgaaaaatataataagatttcttccatatttttatcacctcattattatatacttcattaaacttaaaatcacttttaaaaatcaaaaaaatgtcattaaaaatcaaatgacatctgttttgataatatcttttggaccggtccaaaagatttacgatgaattggacaaactccatattttcccagagcttctttatgtgctttcgtaacatatcctttatgcttttcaaaaccatattcaggatactccaaagcataagcttccatcaaacgatcacgcgtcactttagccaatatactggcaccagcaatcgagatacttttagcatcacctttaatgattgaaagatggtcaggataatcaatcggcattgcatctgttaatgcaaacatcttctctttttttagtagttctaaacatttttccatcccctgtttacttgcttggtacacattcaaacgatcgacatctgcaacactaataatttcaatatcataatataatgcattttcaataatcaaatcgtacaatacttctcgttttttagcacttaactgctttgaatcattaattctttcatcataaaaccctttaggaaaaaccactccagcaacaaccaattctccagccatcggaccacgaccagcttcatctaaaccaatgatatagtcatatccagcttgataatacttttcttcatactcatagcgttccatttggcaactcccaagttattttccccatattaccatcaaaaatatcattaaaaaacacttccataacccgatcatagtcagtatagccacgcactggtttgattttacgattttttgcaatatcatcatatgctttttctacccaatcggtatttaagtcgattataatattgtagcgattacaaacaatgtttgcataatgggtttctaaataattaacagcataaataaacaattcatcaagtggtaagatatcttgcttgattgacccgatcaaagcaatgtttcgagcaacattcaaatcatcaaatttcggccataacactcccggcgtatcgaataattcaaaatctttgtctactcttataatctgttgagctttagtaaccccaggtcgattcccagttactgtcgcttttctttttgctaaacgatttataaaagttgacttcccaacattaggaattcctaaaaccattgctcgcattgcccgtggttttaatccccgcttagcttcacgttccattttttctttcaatatttctttgcatacatcaatgaccaactgatattcattaaaattctttaaattcacacaaattgcataaataccttttcccttaaaatactcaatccacttacttgttgccttagaatccgctaaatcttttttcgtcattacgatcaaccttggcttattattacaaatttcgttaaacattggattttttgaagataatggagccctagcatcaacaagctctatcactatatcaatcaatttcattttttcactaatttcccgacgagctttagccatatgtccaggaaaccattgaatctgttttaccattttaaacctcctacttaattaaattcatattttttaacgggaaaataactaaaccttttttgcctataatgtcactatatttaaatgtacctaaagttctagaatcagcagattgtaaccgattatcacctaatacaaagatctcatcgtcatttaatgtgatttcaaaatcattagtaaatagttccgtttgatattttattttagcttttgcgatataatctttattcaagtacttttcatcatagtatgttccattaatatatagtttatcatctctataaacaagagtatcaccaggtaacccaattacccgtttaacaatatccttatccaatttttcacatttcaatacaactatatcaaaacgttttatatcacttcgctcaagtgataacgcatttactattgcaatatcttcatcatgaagagttggatacatactttgaccatcaaccctcaccggaataattattttagtaaaggttacagttgtaactgcaacgattgccaatagttgtagtgaaaacttgataacttcttttttctttgacataaaaaagtcctcctacattatgtctattatacaaaaaattagaaaaaaaagaaatggcgagccatttctattttctaatttctttaattctagcagctttaccagataatccacgtaagtatccaagtttagcacgacgtactttaccaactttaacaacttcaatatgatcaataattggagtgtggacagggaaagttctttcaactccaacttggtaagagatttttcttactgtaaaagattcagaaattccactaccttttctggcgatacaaactccttcaaataactgaatacggaatttttcaccttctttaatttttacgaaaacttttaatgtatcccctgctttgaactcaggaatatcatttctcatttgttttttagtgatttgttctactaattgtaaattcattactatttctccttatcaaaattttgtcttaaacgttcattcgattaaccagcggaacatctgcagtcttgcgactgttacattatagactaatcaatcataaaaatcaatcattttcttttatttttttcatcatttcgatactttcagcatcaaattgatacgattccaataagtccggtcgtttcaaataggtcttttttaatgattggaacttgcgccatttgcgaatattttcatgatgcccactcattagtacctcaggcacttcattaccatcatagcattgtgggcgagtatactgaggatactcaagcagtccatggctaaaagaatcatccatatgactgtcttctttgattgctccatctaataagcgtatcactgcatcactaacaaccatacttcctagttcaccaccagttaaaacataatcaccaatcgataattccatatcaacataatcacggattcgttcatcaaaaccttcataatgaccacaaatgataattaaatgttttttagctgacaattctacagcacaaccatgattcaaagtaatgccttgaggtgacattaagataataaaactatcatcagttgcaattgttttgagacattcaacaattggtgcacacattaaaaccatcccttgtcctccgccataaggataatcatcgacatgcttatgtttatcaatagaaaactctctaaaatcatgtaattcaatagtaactaaacctttgtcaatcgctcttttgatgatcgacgtatttaaaaaacctgtaaacatttctggaaacaatgttaaaatatcaatcttcatcaataagcccctttattagcataactacaataattttcttttctacatcaacatctttaataaatgcatcaacatacggtattgcaacatttttaccattatgatcaatatttaaaatatcatgacgagtattatcataaattgaagtaactggaccaatttttgttccctctgtagaaacaacctgcattccaattaagtctgtataaaaatattcatcagcatctaagagttcatcatctttatacccataaacaaaagaaccaatatatttttcaaccaaattaatatcttgattatccctaaatgatactaaataatttcctttgtgtatccgcgatgtaataattttatagaccaaatcttgattttgataacttataataatttcgtttccttttttaaatcttttatcagcaaaatcactatttgatctaatttttagttctccctttaagccatgtgttcctactatttttccaattttaagtttttccattagtcctccatataataaaagatgtgctcagcacatcttttattgttcatacgattcaaacttaatatctaattttttattggccatgcgaccagcaacagacataagctgtctaattgaattagccatcatacctttacgaccaatcaatcgcgcaatatccgatttagctgaataaacatgtagtaccactacatcttcttctaacgacggcatttcacgtacttctaaatggtctttatcttcaactaattcaatcgcgatatctttaagaatctttgcgtaatccatgattatttacctgatttagaatcagcaaattttttaataattccttctttagatagtaagtttttaactgtatcagatggttgtgctccattgtttaaccattttaatacttcttcttctttaattgtaacttttgcagggttagtgcgtggatcataagttcctaatagttcaataaaacgtccatctcttggagctcttgaatctgctgctacaattctatagaaaggagctttcttagcacccattcttaataatcttaattttactgccatatacatatcctcctaattaatttactcactaaatttatcatactctagataaggtgtcaagcttttttacttgacagtgtttatttttttctagcagaaacaatcagcatcatcgggcggcgtaactcatccttaaactcaggatgtgcaataagggcatttgaacttaccgttggttctttaacttgaattatttcaaatccgccatttaacagttcatttaaataagtcgtcaatgtgcgatgatatttaattactttttctcctaaaaacaccgcctcacgttttccttcaagataataattatctacaggaaaatgctcaatttcaccagcttcattataataccagtcttgatctcctttagcagtaaatacaggatgttcaacattaaacaccaaatatccacctgtttttaaccatttatttactttttttacaaaatcttggtaggaaggtaaatagtgaatcattaaagagcaaataacaatatcaaatacagcttctccaaaattactttcttcaaacgaaatgcattcatatttaatccgcggatcattgtttttgattcttgctgtttcaatcattttgctagaaatatcgcttgcgataactttttttgcaccgtgttcaatcgcatatatagagtgccagccatatccacaacctaaatccaatactgttttatttgtaaaatcaggtaaaactcgttgtaatacatgccattctcctgcaccctctaatccatttttactccgcgacatctgactatatttttcaaaaaaggctggatcatcatatttattttgagtcattcatattctcctttagtaataaaaagcctgaatttatcaggctattttttcttctttttatgacggatttttttacgattaggattaccgatattagggttctttgcacgtccccctggcattggcatacctgtattaggatcaacattacctaacatcttcatcatttttttagattcttcaaattgttttagcaagcggttaactgctgcaacatctttaccacaacctttagcaattctctcttttctagataaagtaataatacttggatctcgacgttcctctttggtcattgaaaaaataattgattcagtcatttttaatttcttttcagagtcctcatcattcatttttggtaacttaggcattcctggaatcattttcataattcctgatagtggccccaatttccttaactgctgcatttgagaaagcatgtcatcaagaccaaattgtcccgattgcatctttttataggctttcattgtatctttttcatcatatacatcttgtactttttcaactagagatacaacatcgcccattcccaaaatacgatcagccatacgatcaggatagaataaatcgatagcatctaatttttcaccagtaccaatgaatttaattggtacatttgtaatatgacgaattgatagagctcccccaccacgagagtcaccatctaatttagttaaaacagccccagtaatgctcaactgttcattaaatgaactggcaacattaacaatatcttgtccagttaaagcatcaacaactagtaaaatttcacttggatgagcgatctttttaatattagccagctcgttcattaatggttcgtcaatatgtaaacgccccgcagtatcgataataattacgtcattattatggtcacgagcaaatgtcatcgcttcttctacgattgattcagcagattgtgatgtccctttttcgtagacaggaacattcaattgttcacctaatgtttttaactgatccacagcagctgggcgataaatatctgcagcaaccaacaatggttttttaccatatttcttggtaattaattttgcgatttttccagaagttgtagttttcccagaaccctgaagtccaaccatcataataacagttggcttcttatcaaaatcaacttccgcaacacttgttcccagtaacgaaactagttcgtcatggacgatttttacaacaacctgtcccggttttaatgaacctaaaacatcttgtcccaacgctttttcttttgttgcagcaataaactcttttacaacttgaaagtttacatctgcctctaataatgctaagcgaatttcgctaagcatttcttccatatttttttcagtcaaacgcccttgtccagaaactttctttaaagtcccttgcagacgttctgataatgaatcaaatgccataaatacccctttctaaatcttccttaataattctaaatattcttctagacttttatgatcactagatatatcatcttcaattctttggatcaagtcaagcctttcttgatgtttttttaacaactgcagtttttcttcataattttctaaactatgaactgctttttttaaattatcaaatacagcattacgactaacatccaaaatttgtgcaatttccgataaagagtaatcttcttgatagtaatattctaaatatgtttgctgtttttctgtcaacaaatcactataacaatccattagtagattaactcgttgttttttctctaaacttgattccatactattcctcaactaggtttttgcataacccatatatatactggtctaaatcaaattcttgtaaatcatcaacactttctcctagaccaatgaattttacaggtatattcaattgatctttgatagaaagaacaatcccccccttagcagttccatccattttggttagaactaaccctgagacatcagtgatcttagaaaattccacagcttgtgaaacaccattttgaccagttgttgcatcaataactaacagtgtttcatgcggtgcatcaggtacttcgcgtttaataatacgattcattttttctaattcattcattaagttgaccttattttgaagacgaccagcagtatcacaaattaaaacatcaacatttttttcttttgcctgttttaaagcatcaaataccactgctgaaggatcaccgccctctttacctttaacaatatcgacaccaacacgctgtgcccaaactgctaactgatcaatcgctccggctctaaaagtatctccagctgcaaccattactttcttaccttcatcattaacgatacgattagctaatttcccaattgttgtagtcttaccagccccgtttactccaaccattaaaattactgttaatccttcctcagcatagttaatcttagttgtcatgacactatcatttgcataaataacgaacattttatcaacgatgatctcattaatctcttttgggtcagtaatattttgcaaacgtacctcgtttttaatttcttcaactatcttcattaccatcgaaactccaacatcggacataatcaaaatattttccaattcttcaaaatactcatcattgatttctctaaagcgagctgcaagttcattgattcgatctgaaaaagtactattagaccgatctaatccagctacatatttttcgttttgtttagcagatttaccaacgaatttttcttttatttgactaaaaaatcccatacgattcctcctaactttgatctgttaaatctattgcttcttctaatttgacactaactaactttgtaactcccttttgttgcattgttgctccataaagaaggtcacattcttccattgttccttcacgatgggtaaccacaataaattgcgtcgttcccgaaaattctcttaaatatttagcaaaacgttcaacatttgcaatatctaatgcagcttcaacctcatctaagatacacatcggaattggccgtacccgtaaaattgcaaataaacatgaaatagcgatcaaggccttttccccacctgaaaataatgtaatattctggactgctttacctgggggctgaacatcaatatcgattccagtttcaagaatatttgtaggatcagtatactttattctagcctttcctccaccaaataaactcctaaagacatgattgaactcttcgttgattttctcaaacgtttctgaaaaacgctcaaccataatttcatccatctctttaatcgcttcaaggatactatcttgggcttgaatcaaatctatacgctgagtattcatgttctcataacgctcactgattatttgatattcttcaattgcatcaacattaacgtttcctaaacgattaatatttgttcttaattcgtatacttctaatttagcttgttcaatatcaatttcatcaaggtaatgctcgacagcatactcataagtcatccgatattcatcatttaatctagctaaatgattatttaacattgcttctaattttgttgcattaatagcactagtattaacctcactttgaacctcttttaaatcattacgatattcacgcaattcaacatctaaagcttcattttgattaacataggccattctaagttcacgttttgatttaatttcttcagttaaattatcacgatatttaatcgcttcatttaactgattaactaatttactttctgtttttccactagcaaattcttctaattcaacactttgatcagctaatgattcatactcggattttgccttgatcaactcttctttcttgctttgaacaacaacttccaatttagcatatgccatctgcttttgtaatagagcatgtgaaacttctttgatttcattatccaatccattatgttcattacgcttaagcccaagttctttttcttgttgttcaagagtaacagcaacctgctcaagttcacgtttttgaactattgaagatttttgacgattaaaacttccacccgtcaaagaaccgccaacattaacaacatcaccttcaagagaaacgactttgtaccgagaaaaagttgctttgctgatttcattagcactatcaatatctttagctacaataatattccctagttgatttaaaacaacggcagcaatctcatcttcatatgttacaaaatcactagccaaacctaaatatccttccatggtttgacaaacaactaaatgttcttcacgcacatgtcgtggtttcatagcactgattggtaaaaaagtagctcgtcccgctttattatcacgtaaaaatttaattgcatctcgtgcagttaaatcatctgttgtaacaataaactctattgctcctgctaaagctgaagacaacgctaattcatatccttcatcagctgtaattaaatcacctaaaacaccaataatatttttattacttttagcaagacttaaaactgttttaatgccatgatgataatttgatttattttcaatcgcatctattaaaatctcttttcgtgatttatttttattaatattgtttgataattgatcaatttcattttttaataaaagtaattttttattacgctcctcttgttgtccaattatcgtggttaactctttttgagtgttatctaatcgttccacacgatcattatattcattaacaacatcacttaaaatcgccttcatattagcgatattttcttttaaattttctttacttaaggtctcaagtgcatgttttcgcttttgatcaacttcgactttggcagtctctagtttcgagacatttgatactgcctctaatagtttactttgtaaagcatttatttcttggtcgagagtaaacattttcttttttatttcatcgttactgctctctttaagcaaaatatcagcctctaaagaagcttgacgctcatttaagtccttgattaccttactcaattcatctagtgatttttttgcttcagttatctcatttattaaaacattaacttctatagctgttaatttttctttcaacgctaaatacttctctgctttgtctttttgacgtttaagaggaccaacctgtttttctagttctactacgatatcaccaattcgttcaagattttcgttagtacgttctaatttacgaatcgattctaattttctttttttatatttagaaactcctgctgcatcttcaaaaataccacgacgttcttctggtttattgtccgcaaaagaagaaatattgccttgggaaataattgataacgaatcctttcctagacctgtatccataatcaaatcaataatatcttttaaacgacaagattgtttattgattaaatactccgcttcattattcatacgataaagtcgccgtgtaatctcgacttcattataatcatatttcataaaacgatcactgttatcgaaaactaaggtaacttcagctaaattttgtgcccgacgatcttcgcttccagcaaaaataacatctgacatatttgcaccacgcaacgatttaactgactgttctcctaaaacccaacgtacagcatcagagatatttgatttcccgcaaccatttggacctacgattcctgtgattccaggttgaaattctacattgactttatcagcaaatgatttaaaaccatgtaattcaattctttttaaatacattactttcttcctctcattatttcaggatcaccgcaccatccctaaatgcttctactactgctaacgattccacacgatagcctttttcttcaattaattggcgacctgtttgaaaacctttttcaacaacaattccaacaccagcaatatttgcacctgcttgtttaacaatatcaactaaacctaatacagcttgaccattagctaaaaaatcgtcgataattaagatattatcatctttatctaaatattttttactgacaatcgcatcataatcaattcctttagtaaatgaatgtactttagaactataataatgtgtacttgttgtttttgcagtccctttctttgcaaagacaacaggtgcatcatcaaattcaaaagctgttgctaaagcaatcccaattcccgaagcttcaattgttaagattttagtaatttttgtgtctttaaaacgagctttgaattcttgagctatttgtcgatacaaagtaggatcaatttgatgattcaaaaaactatccacttttaatatatccggcataattacaatcccgtcttttaatattctctctttaagtaattccataaattcctccgattatttattaaacgatagtttttctttaatatcaaaaacttttcgttcgcttggtaattttactacaaaagtagagccaacatcaacctgggaaataacatctatatttccatgatgtaaatctacaattgtttttacaattgataaccctagtccatttccttctacagaacgggctttttcttcacgataaaaacgttcaaatatatgtgaaacaacttctttagacattccgtatccagtatcttcaattgatacttcaacttcacgagaagcctttttaacagctactgtaataagaccaccttcaccagtatatttgattgcatttgaaataagattgatccaaacttgttccaatcgttgttcatcgccataaaccataatatctttgcgcggtttttcaaattgaatttctatatcctttaaaattgcttggttttcttgagtagaaataacccgagataattgctcaacaattgaatatgttgtaaattctaactcaacctcttctcgttccaacaacgtcagctgcagcatattcttagaaagagtcgataacctttttgaatgaaataagattatatcagcatacttttgacgctgctctttaggaagatcttcctcttttaaaatattggcaaagccttgaattgcagtcaatggagtttgaaattcgtgcgaaatatcagaaatgaacttttgtcttgtttcttcttgtttcgctaactgctgtgccatttgattaaatccctgattcaatcgagaaatttcatcatcacccacataattaacacgaacactataatttccttttgataattctttagtggcgttagttaatctcgttattggtttaacaataatatcagcaatcgctaaaaaaactagatttcctgataaaaagacacaacccaaaatcaaaacagcagaattagcaaaaattcctttttcataactagtatccttttgaataaatatatatacatcagaaccattgatttttgccttgctgccataggtttgcacacttttgcgctcatcgaaacgcccgtttttgttttcatcatgataatattgaatcattgtctcgcgactaggaaaatatcctttgttttcaccatatgtataatagtccaattctggtgaatacaacgttatataaacctctgagctaattgcgtatttattcataatatcgttaatattagcatcatcaaggctatttaaaatacctacaacatattcacttgttgcactcaactcactcttagccatatcttcaatttgatcataattattacgtaaagctacatatccagcaaccgaaaaactaaatgcgatagttattaaaaaaccgcaaatcagcttgccataaatagatttcatcattcgacttcaaccttgtatccaagtcctctcaccgttacaactttaaatcctggtaagtgtcctagattttctctaattcgcttaatgtgaacatctacagtacgatcaaagccatcatagtccattccccaaattttttcaatcaactgttcacgactaaaaatctgatctggatgctttgctaactcaaaaactaattcaaattgttttaacggtaaatgaatgatttcgctctgataacgtatctcatatttatcgccatcaaactcaacttcatttaatttgattatatttgatgtattaacactatatctttttaaaactgctcgcactcgtgccattaattcagttggatcaaatggcttaactacatagtcatcagcaccaacagaaaaaccgcgaagtttatctttactttcacctttcgctgttaacataattactggaacatctttaaattcctttagattttctactaattcaaaaccatccataactggcatcatgacatcaataattcctaaatcaatatattcattttcgaatatttctaaagcctcttcaccattgctagcttccagaacttcaaatccttctttattcaaataaaaattaattaattccctaatatctttttcatcatcaactactagtacttttgctttcatctttacacctcaattcactgtaagattataacacattttattaactaaatatatagttacaaaagcaaaatagcttgagtttaaagagatgataataaatataaaaaagccataacctatatataagttatagcttcttgttctattaaagactaaccaaatttaattgaagtaattacctcgctattgtctttactattaacatattcaatggttacaacatcaccaacttttgctaatgggaattgattagataaactgatatctccgatgaaaatcgtatcactaccttcaagtttaaaataataagtactgttaccatcaacgacagcttcattaattgcagtaatcgctccagtcaactcattagtcttatattcacttgagtcagtttttttaccattagcttctaataaagcataatatgcttgttcagcttgagcaacactgtcaccggtagccacgatttgataattttcaacactaacaaaagcatactttttaacaagtttagcatcatcttttaaagataagaaatatgttggctgccctcccgcattgatcaaaatcggaaaagttgccgtatatttcaagttttgaacttgaccttccgccgaagacattgcagaatattcttcagctccagaaatattataatactttccatctttagtccgcaaattaatcatagcaaacccaacgttagaagcatcattagataccgatgttaaaccagtatataaatagacatcatcattgattgctacataattgtaaccagaggttggctgtaatactcctttttgcgaaaataaagtattaaaatacccatttgtatatttaccataattttctaattgacttaaaaccagttctgctggataagcacggtcaacccattctggtactttatcaatatcataatattcatgatcaccatttattgcattaactaatacagctccagttatatcttttccaccaaataaaccgattttataattatatactggtgcaatccaataaggattccccttttcatcaatttcaaaagccaatgtatcaaacattaaagttggataattagcgcgcaaatgacgttcaattttacgtccaaaatgttctgatttagaatatttcattccttcttttaatttaactacttcagattcttgcgtcaccatatttactcggatatatgcgggcagtccatcactacggttagtaaaccatttgatcaagtcactatattctaatggtgtcacacgatatggcgtatcttgataatttatttgttcatacgactcatcaacttcaaattgggatacataatcaaccatctgtcccattttacgatcacctaatttaatcgcactatctcgatccaccactggaatcgattgataggaaatagttttattgtcagcatagaagtctgctttcttatctaactttaattgtttttgataacttcctgcattaaagataggcgaactaacaaatgttccaatggccacatatgcaattaatattccaatcacaatgagactatatttggtgatcttactaaatctttgacttaacataaaatatagtccattaaatattaataataatatacaaaaataaattataaattgtggtgaacgaagattcaatgggatcaaaaaagcatattcaccaatcaatccaattattaaagttattgtaaacgcctttaaaaaagcacctttttttacttgttttacatcttgagaaccttgtctaaatgaaaaaccctcaataaaatttgcaaatatgtcagtaaatttattcattgattatctcctttaaatcttgaagcagttgaccaagctgttctaatgaagctaactttgcgccacttgccagcatatgaccaccaccattatatttttcagccaccttattgactgcgtaatcacgtgaacgtaaactaacacgccaattatgatcagcgacattttcagttagagccatccaaattttatattcttctacaccagataataaattaacaaaatccgaacctctttcacgactaatttctaacatttttaaatctgcatcacttaaaacataataagcaacaccaccatcaaactgatgattatttaaaataaatttattaatttgtaaatccttagccttcttcatataaattcgattatagatttcaacaatatcaattccttcttgaaccaaagctccagctactgcaaaagtccgttcatcagtatttcgatacataaaccgcgctgtatctccaacaattcccaaatacaaagcttctgcaccacttttagtaattttcatagccgtatctttaaaaattgttccaactaattggctagctgaactagcactactatcttcgtaatttaaagtgccataactatctacgaccaaatgatgatcaattttaataatttctttacaaagttgatatctttgatcatcaattctttcaatattagcagtatcaagaacaattcctaaaatatctttagtataatcaacttcttgatgttcaaaaactactgtatattttttcactaattccgaactgaaatcaccacataaaaaaacctttttatctggataagtagctttaatcatatcgtacattcccaattggctgccaaaagcatcaaaatctggatttacatgacggtaaatagcaatataatcatattcttcaattttagcaattattttttcttccattataaaactcctctatttaataagatgactataccatatttacccaaatttataaatagaaaagctctgattattgatcagagcttataaacctaaaattcttacagtatcacgagcaatcattacttcctcgttagtagggattacataaacatcaactttagaatattgatgggaaattagacgattttctttactacgacgttcattttcttcttcatttaagaaaacgcctaacgcacgtgaaacattatcaatgatcaaacgacgaagataagaagcattttctccaactccagcagtaaaggcaatagcatcaacaccacccatttcaacaaaataacttccaatatattttgaaacgattcgtgcatataacaaacctgtaagaagtgcacgttcatcaccgttcttaaataatgcattttcaatatcacgggaatctgaagaaattccagaaattcctaacattcctgatttcttattatagatatctaaaatttcatcaggtgttttatttaattttttacataaatacggcataatagatggatcaacatcaccacagcgtgttcccatcattactcctgccagtggtgtaaatcccattgaagtatcaatacatataccatcctgaactgctgaaatgcttgcaccatttcctaaatgacaaacaattactcgcgaatgtttgggatttcctaacatatcaatggcaacttgagatacatatttatgacttgttccatgggcaccatatttgcgaacttttaaatctgtgtagtattcatatggtaaaggatataaatatctttcccggtcaagagtttgatgaaatgcagtatcaaatacaaaaacatgttcaacctctggtaaagctgctttaaatgcattatatccaacaatatgtgctggattgtgaagtggcgctaattcagctaattcttctacgcgagcaacaacttcctcgtcgactttaaccgcgtcgttataatattcgccaccgtggacaactcgatgtccacaagcttcgatttcacctaaactttcaacaacatggtgatcaactaaagcatctaataataattgtactgcaacactatggtctttaattggacactctttaataaatttttcaccattatatttcatttcgaagttaccttggtctagtccaattctttcgactaaccctgatgtaattacttcttcactaggcatattgatcaactggaattttaaagatgaactaccagcattgattgccattactttaaccattataattcctcctatttcttcatgtcatatattaattgtacctaaattcaacactaaactcaatatattttgaaagcactttcaccatttattaaagtatttattggaattatcgaataaatttgttttatatttaagaatattttaaaaccctagattgaactagggtcttaaaaataattatttagattgattgtagttattagatgaactcatttgtgattgacccatttcgactaatctttttgtgatttcgccacctactgaaccattcgcacgagcagttgtatcaggacctaaattaacgccaaattcgttagcaatctcatacttcatttgatcgattgcattttgagctccagggacaactaatttgtttctactagagttattttgtgacatatattttcacctcctgacagtaatattttgtgtcatttgttttaaaatatacatttttaataaaaaaatttaaatttattttttaaagataaaaaccctagctaactagggttttaaaaataattatttagattgattgtatttgtttgatgagctcatttgtgcttgacccatagcgactaatcgttttgtgatttcgccacctactgaaccgttatcacgagcagttgtatcaggacctaaattaacgccaaattcgttagcaatctcatacttcatttgatcgattgcatttttagctccaggaacaactaatttgtttctactagagttactttgtgacatatatcttcacctcctgacactaatatcttgtgtcaaacaaaaaaagatatacgcttttttaattatttttaaaaaatatcgtcgtttttcttataattgtgatcgactgtaataatttcagcagtttctacacattcatcaatcaaagtttcaaaatcaaacccagactcaaatatttccgctttatataacttaggcttagttgccggagctttaggtgtaaaaatagtacagcaatcttcatgagggcgaatcgaaatttcataagtatcgatcctatcagcaatatcaataatttctaatttatcaagacataatactggtcttagtactggaatcttaacaacttcattgattacctgcatactatttaaagtttgtgaagcaacctgtccaatgctttcaccattgactaatgcaagacaattatttttattagcaattttttcactaatacgatacatcatccttctcatgactgtcattgcataactttcgtcacaattatcataaacagctaattgcaattttgtaaaattaattacatgaactctaattgaaccgtgagtataatgacgtaatttatcaactaaatcaaaaactttttctcgtgccaattcattagtataaggtggtgcagcaaaatggatgcactcaatatctacaccacgttttaatgttaaatatccagctactggtgaatcaattcctcctgacatcatcaataatgcttttccaccaactccaactggatacccacctgctcctttaataatattatccattacatatatcgcgtcataacgaatttcaactgttactaaaattgctggagcatggacatcaacttttatttcttttgtagtgtgatgaaatacatatcctgcaatttcacgattaatttcttgagaacttccagggaaattcttatctgaacgtttagtattaatcttaaacgtattcccatcattgttttcaattatttgtaaaaccgcttgtttagctaattcgagatttttttccattttatatgctactgaaaaagaatagattccaaatactgttttcaatttcgtacatacagcttcatgatcagtaccatttagaacaacatacatacgatcatgttgtaaatcatatgttaaatgattaaattctgctaatatctccttagtattttttaaaagacgattcgtaaataatttacggtttttaccttttgttgttaattcaccaaaacgtactaaaatataatttgcttccatattctacctctgcttctttaatttacgcatactttcttgtaaataataacaaaaccgatcgatttcttctcttgtagtatgctctccaaaactaattctaagcgcactagaactaattgcttcatctaaatgtaattgcgccatgactcgtgaaacattgctcgtttttgatgaacaagcactacgcgttgataaatatatttcttttgtttccaaatcatgtaaaataacttctggtttataacctaagcatgagaaattcaaaattgatggtaaacagcaattttcatcactattaataacaattccttctatctcctgtaaacattttcgacaataatcatttatatctttaatatgttgatttttttgttcaaaattatctaatgctaatcttaaagttttcgcaaaaacaatattagtacaggcattagaagttccacctcgtaaactaaattcttgttgtccgccactaattaaaggaacaattgtcgttgaacgtcgtttgaataataagccactaccttttaaaccataaattttatgtgccgaaaaagaagctaaatccacatcatttaaatcgattggtaattttcctaaagcctgtaccatatcaaaatgcagttttaccttatcgtattttttaacaatttttttaatttcatcaataggattaatgaccccaatttcattatttacatacataattgatactaaaatcgtatcatcacgaatacttttttctaattcttctaaagaaatccgccctttatgatcaacccctaaataagttacctcaaatccaaaaaacttttctaactctttacaagtttcataaacagatgaatgttcaatagctgtagtaataatatgtttaccacgattttgatattgaaaggctgtacctttaattgccatattattagcttcactaccacagctagtaaaaataatttcatcttctttaactttgaaggactcactaattaatttacgtgaatgttccatcaaacgatttacctcaatacctttatcatacattgaatcagcattataaaaataattggataataaattatgataagtatttaatacttctgaatttaatggcgttgttgccacataatctaaatatatcatcgtaaccccctacattattatatgcaataaaaatccaaagtcttatgactccaccaaaatatctttcaaacaacattaaataattctacaatatttactacgaaagtaaagaaataaaatcattttcttacttgcaattccaaagtactttaattttcctatataattacttttataaaaccaacgtaaaccatcaaattgtaattatcttaaatattttaacacaacactttttacttatccaccagcattttcttagctggaacaccaatcgcaacgatattatcagaaatgtttgaaacaactaccgctccagcaccaactgttacccgattaccaattctaatatcatcaatgacagtactacctattcccagataagatttatatccaatcgaactgtgacctgccatcgcaaacttaggacaaatattaacataatttcctaccatacaatcgtgttcaataattgctccattattgactatacagccaatcccgacctttgtattaatattaattattacattagccaatatcgttgtaccactaccaatctttgcagatgaactaattaaagctgttggatggactatcgttgctaaaggaataccaaaagcaagtaacatttttattttttcttctcgtaaatcattgctaccagttgcaacaataacctcatcatataattttactactttatcgaattcactttctttaaatacagtatgattaattatttttctacttcctttttctttgatttctaaaaaatcaatttgttcatatgcattcatggctaaagcacactcaagagtcacaagtccttgatctcctgcaccccaaattaataattttttcatttttatctcctatttttattaataagctttaatatccccattatattacttttaaactataataccttgtacattcttcataattatactctcacccataaaaaaaggcaaaatcttatgattttgcactatttttattaatcaacatctcatatgatccaggattgattttttcaataatatctactgcagtagtcaaagctttagtatattcaccatttctaaataacagctctgctttagttaattctgtgttaacttctaaaaaagaactacgataacgattaccataaataattgcatcttcaaccatttctgcagtaacaatcaaattatgaacattatcatataatttatagattacatctcgtgcagcatcaacttgaactgagagacgctctaaatcaattggtcgacgtctgataaatttcaaaatttcatccgctttttgataagaatcatcaatataatctttataagattcattaatcattggtaaatgtttatttttaatctccgattttatttctagtaagacaatattaatattatctaactcatctaaagcacgtttttcttgtaatctcaaagaattttctaattcaatatacttattcaaagattcatcaaaaggtttacaacgatcaatcaattcttcaaaacgctcaatcaagacactatatgaaaaatcattgctttcaattattactgttaattgatctaattcatctaaaatccctttaaaagcctcataatcttctttaacagtaatttcataatcagataataaataattcctttgaagttcacctaaagaattaatagtatttcgaaggccttcatctaaatgcccaatatgtttgtaacaagcattacgtgattcctcatagcgactatatgcagcttcctctttttcaaagtctgccgctaaagaatttagatcttctgtcattacttcaatggaagcaccaacattttctagatttaactctttaatagcttggatcgtattttctagatcagcattgatcttattatagcgaactgttgtattaagacgttcaattgaaaaatcgcgttctttcatttcagtaataacacggtataattcatctaatcgcttaggaatatattttcgaacaattgaaatataagttggtaaatcacgaagataagcacttaatagatcaatgtctttatcaattttatctgctgatactttagcttcatcaaaacgctgactattcatcaatgcttctaattgaacaaagcgttcttcaatatctgcaaatttttgaggaatagcaggtacaaaatcttctattttaaaacgtacagcagcaaattcatcatttgttaaacggaacttctctttaattttaataatttctacacgttgcacattttctatttcagtgatcacctcaatttctttaagcaacgccttagaacgtttctcataattatcaatatcttgtcttaatttatttagatctctgcgaaccccttttaattttcgataaaacaatcgctcatcaatatcattgatcaatggcgcaatttcattactttgtagatttactaaatcattaaattctagttcaaaatcatcatatttttctaaaacatctggcatgttttttccaattgctttaatccgccctaagcggtattgaattggcaaagttttaattgcattcatatcattttctaaaactacaatttctttacgatatattcttaatttaatcatccagtatgttattaagatcacaatagttacaattaatactacccctactatgattacattttttgttccaaatttttttaatatattatctaaaaagtccattatattacatccctcttttttataaatcttactaataaagtataccataagtgtcatatgatgtctaagtaatatctgtgcagttttaaattatttttataattctttacattatttttgtttcgcgtaatatataaatacaggaggtagtttatgaataaaaaaatcttaacgccaatgcgaagctattctcaacgcagagtttattatatttaccgtgaatattttagaatgcttcaaactgcaaatctagatcctattattattggaccgagcagtgatgatacactagattttttagtcactcactgtgatggtctattattaagcggcggatttgacattgatcccgttttataccatcaagtattaaatcctctaaccaataaagaggaagcagaattggaagaattagaaattaagttgattcataagttttcaaaagctcataaacctatattagggatttgccgtggaattcaaactatcaatgttgcatttaacggtactttgattcaggatattcctgagacaaaaaaatatgataatcatctccaggaaaatttagaaggatatcatcatctcgtgaaaactattcctcatacaaaactaaataaatatttaggaaatgagtttatgaccaattcatttcatcaccaggcaattgatgatattgcccctggctttgttgtcagtgcaattactgctgatggaattattgaaggaattgaaaaagataatattattgctgtacaatggcatccggaaaaaaatcatgataaaattcaagcaggtttaattaaattatataaagagttactggaggaagaaaaatgaaaaaaattgcatttattggggtcggagtaatgggtaaagcaatggttcaaaatttgagtcaagcaggatatcctgtatctatttatacgcgaacaaaaaataaagttgaagatcttattagtgataaaattatatggcacgattcagttgctgagtgtatcaaagatcaagacattgtcatgactatggtaggatttcctcaagatgttgaggaaatctactttagttccaaagggataattgctaatgctaaaaaagattgtattctcattgatttcactacgtctagtccattgttagcaaaaaaaatttttgaagaatcttcaaaacatagtttagccagtcttgatgctccggtatcaggcggtgatattggtgccaaaaaagggacattgtcaattatggttggcggtgatgaaaatgtctttaaacaaattgaaccagtgttagaagtcttaggaagcaacattaattatgttggttcagccggaaacggtcaacatacaaaaatggccaatcaaattgctttagccggagctttagctggagtttgtgaagctcttacatatgctaaagcagtcaatttggaccctcaaataatgcttgactgtatttcgaatggagctgctggttcatggcaaatgactaataatgccccacgaattcttgctgatgattttgcaccggggttttacataaaacattatatcaaagatatgaaaatagccaaagctgttaatgatacaaacaaccttgacttagaagttttaaatactgttttacaacagtttgaacaattacaaaccgacggatttgagaacttaggcactcaagctcttattaaatattatcaaagatagttatgaactaactatctttttttgtttgcaataaccatggctacaaccattaaaatcatcgccataaatttattaaaattaaaattttcttgtagtaacaatgaaccaatatatgtaaacactggatttagtcctaataaaaaacttgttttaacacttccaatttcgtgaacagctcgaaaatacgttaattgaattatagcaaatccaattccagaaaaaattatgaaaagtacccataaagttattgaaatattttcaagatgattgctgctaggaataaataaagtaattaacgctaattgaaagaagctcaaacataaatattgaaatgtaaaaggtaaactgtcttcttttttacattggtgctgcattaataaattaccataactatataacacaattccaccaatcatcattaaatgaccaagagaaatctgactaatattaaaatctagagaaataagaaatccaatgcatgcgattatcatagcaatcaactggtaacgattgaccttagtatgataaaaaagccatgtcaataggattgtcactagcggtgctaaggaattaacaattgcatttgaacttccggtaattaaattcaatccctcaaaggtaagtataaaattaattgtaatcgaaagtaatgatacctttattcctagactgcctttataccatttaaaaggtatttttttatatttcatgattacaaaaattgcaataaccgacaacagtacttttagagcagctaaaaaatatgttgtagtgttttctaacatatatttcattacaagaacgttggtaccccataaaaaactagaaaagattaaccatccatataacatcatatcaccaaatttattattccccagatattcataaataaaactaataaatataggaaagcaacataaaaaaatgatatgtactaatcatatcatttcattaattatctgctgtttatccttatttaactgttcaattaaatcgtttattgaagggaactttttctcactgcgaatatgtttaataaacataacatttacttgttttccatatacattctgatcaaaatcgaaaatattaacttctaatgaagcttgcttcaaagcagtaaaggttggattatagcctaaatttgccattcctatatattctttaccatcgatgattactttagcaccatacactccatttttaggaagtacataatctattgctgccacattaattgtcggaaaaccaattttacgaccgttttcacgtccatgaacaacttttccagtcacttgatattgccgacctaacaattgactagccaattcaacttgaccattacttaaaacttgtcgtaaatatgaagatgagattttatgctgttcatattctaatttatcaataattgaaatttcataatcattatttctattattttttagataaacactatcgccactaccatgatttccaaaatgaaaatcaaaaccacaaacaacatgcttgatttttggtttaataataaattcgtcaataaactgtcgtggttccttactagctaattgatgattgaaacgtaatacaaataaatagtcaaaatttaatttttctagaaattctattttatcttcgagactcatcaaatatttaaaagaactatctaaaagatatgatttaggatgaacgtcaaatgttaatagccctttttttagattctttatttttgacacttttaatacttcatcaatcaatttttgatgacctagatgcatgccatcaaaaaaacccaaagcaacacaacttggttccaaagcaatcatattttcttcattcaaatatattactttcatcaccataaacctctaatactttttaaataaccatttccatcagggccatacattgcaagaactttcccctgccgatttaagataacaacctgttcatttaaatctgatttgattttttttccatgaaaaattattttttcatcatctacaactaattgttgatatgaatttaaagcttcttctaaacttactgttgtgtattcaccattttcaatctgttcaagtgtaaaacaattttctaacgaaaaatttcctgatttagttctaattaaatctttcatatgtcccggataacctaaagccttcgcaagatcatagcatagagaacgaatatatgttcctttcgaacatcccactttaaatttaattaaattattttcgatttgtaatatttctaaatgattaactgtaactgatcgtgttggcacttctacctgctctcctgcacgagcatactcatataattttttaccatttactttaattgctgaatagattgggggcttttgttcttgagaaccaataaaattattgaaacaagcaactatttcattattatcaagagcatagaactcttttgtttcaataattttaccactagcatcatatgtatcagtacttgttcctagactaagtgttgcaacatattctttgctttcgcttgttaaaaactgcaaaacttttgtagccttatttacacacacaactaaaacaccaattgcatcaggatctaaagttccgcaatgccccactttttttgtttttaatattcgtcttaatttattaaccacgtcatggcttgtcataccactaggtttgtttactaaaataattccatccattttcatcaccgctttacattgtacctatctttacattaaattgcaaataactttgcttagtaatgatatttttgttagaatatagcaaggtgataaaaatgacaatgaaaaaagtacttggctgtattcgtaaagccgatgaagaatttaatttaattcaagatggtgataaagtatgtgtgggcgtttctggtggtaaagattctatgctccttttatactgcttatcattatataaaaaattcgcaactgtaaaatttgatgttattggagtacatattgaaatgggcttcccaaatatggattttagtgaagctgatgctttttgtaaaaaaaatggtattgaactttatcatgaacctagtgatgtatatgaaatcttaaagttaaataagaccgatgatggtcgtctacaatgttcattatgttctaaatttaaaaaagcacttgtaatcgatggtgcaaagaaatacagatgcaacaaagttgcctttgcgcatcatggtgatgatgctgttgagacactatttatgaatatgatctacggtggtaagattgcaacctttacccccaaaatgtatttaacaagaactgaaatgaactttattcgtccattagtttatgcttacgaatcagatatagttagtgctgttgaagaagcacatgttcctattgtcccttcaacatgtccagctgataagcatactaaacgagaagaatttaaacatttactaaatgatctatatttaaaatatccgcaagctaaaagcaatctccttaccagtttaacaaacgaagaaaatacaatgttatggaaaaaaacgccaagaaaaaagtaagttataaaacttacttttttttaaatatgcttaattacaaaataatttttcttgccgcgacgaactacagtcgcctcatttccaaatgcattagcttttgtaactatgaactcaacatctttaattcgttcaccatttattaaaatggatccgccattaacaaattcgcgcgcttctcgtttactctttgctgccccacaagtagttagtgcatctaaaatattcaagtcttcattaacttcaatacttggtacaccttcaaagcaaaccttgacctgtgctaatgttagtgattgaatttgtcccgaaaataacatttttgaaatatttacagcttcctcataagcttcagcaccatgcaagaatgtgattacttcacgcgctaatgcttgatgagcttctcttaaatgtggttgcgttttattcttttcttctaattccataatttcttcaggtgttaagaaagttaaaaattttaaataatcaattactttatcatcttctgagttaataaaaaattgatacatttcatatggtgatgttttctctctatctagccaaatagccttaccattagtttttccaaattttgttccatcacttttagtcaataatggcattgtaaaaccatatgcctctttaccatcttttttgcgaatcaattcaattccagcagtaatattcccccattgatcttgaccagctacttgcataacacaatttttgttattgtataaccattcaaagtccattgcttgcatgatcatatatgaaaattcagtatatgtaatccctgcatctaaacgacgttttacaatatctttgtttaacatatagttaatattaaaatattttccataatctcttaaaaaatcaatgaaattaagatcctttgaccaatcataattattaacaacttcaaaaccaaacaaatcttgtgcttgtttctttaagcaagcaaaattatgttcaactgtctctttggtaatcattggtctttcagtatctggtttaggatcaccaatcaatccggttgctccaccaactaataaaattggattatgtcccgcttcttttaatcgctttgaaattaaaaatgatgaaaaatgtccaatatggagactatcaccagtaggatcagtcccaatataaaaagtcatcccaccattatttaatttttcttctaaatctggtgaactaacatctttgattaatccacgccatactaattcatcataaatcttcatccgttatcctccatttataaaataaaaagagatttcttcctaaaaggacgaaatctcgcggtaccacctttattcatgtataaaatacatgcactcatcattcataacggaactacccgtctagacttttcacctagaaactccagagtgtattcatcagtagtacatccttgtttacaccagccacaaggtctctaaaatgcctattttgattactattttccttcaacgtcgtaatagaattatatgctatatttttaaataagtcaacataccctaataagttttgtcaaaacttatcgttcctgatactatttaaatattttaatcatatttaattttaatgatttactttattttcatataaatagtatccctacattcattatttctttcttcacaagttccttcttcaaaagtaattattttttctttgataacaccattattatactctattaccatgcttatttcatagcttaataattcttgtttaaatgtttgatagattatttgttcgttatctattactgaaatatctttattttctaaatttaattcagtataaagaatatttcgatagtttagaggatcttgctgatcataaggaacagtcatcctatcgccttggttaatttctatccaaaaaagtccgccatacatatttaagctttcctgactatagcctgcttgttctaaagctgcacggtaatctttaataatatcaatgatatgatcattaacgtatgattctaaattttcttctgttaactgatagcgttcttttaaaagttctttatcttgatcacgtaattcgttaaacattttaaattgaatactaaaatcattttttttatttaactccgataaatcatcatgaaataaatctaatgatttaacccgataaaaatctaagctcgtccccttaattacagaatagctgatactcttaatgttttcaccaacaatacgaatatcaaatggtaaacatgagcgtttagcattacatctccaggttgttccaaacatatcactactcatgtcaatactaactttatcgtctgttaattcataggtttcatcattagcataaatatttgtaatgaagtaatcaacatctattaatgtttttgtttcattatctcctcttggataagttctaaaataaattgttcccgtgatcatagctgctatcacgattaaagctgtagcatatttaaatttacagatgctttttttctgtaaaatactattttttactagatcaagcttttgctctggtatcttgattccattgacaatctttttgtaatcattattcttcatgattctgcctccagttctattttcaattttgtacgagctcgctttaacctttgcttaacagcggcttcactaatttttaaaatgactgaaatttccttcactgaatatccctcataataatacaaatgaatcactcccttatatttaggagccagtttaaaaactagttcttgcaattttaaatcactattttctaattgataaaattcttcttcaaaaacactaacatttcttttccaataactttttaaattatttttacaaagattaatacaaactcttaataaccatcttttaagatgctcttcatcgttaaaatcatttttctttaatagcttaataaatgtattttgaacaatatctaaagcatctgcctcattttttagataaagaaaagcgactcgatatatcatatctttatacttttggaatagatgttcgaacattgcttcctccattaaatttcctcccttcatctaaataacaattgaaaattataaatcgtgacaaaaaaaagaccttcataatgaaagtcttagtcatttgtcgaattgcgtttaataaacatatgttgtactgcaatttcttttgaagtaatttcttcatcttgtaggaacttagttaataaacgaacagctaaagcacccatatcataaacaggcacattcattgatgaaagggtcggtttacacataattgaataacttgtattcagcattcctactacttccatttcttcaggaattttaattccattttcttgagctgcattaataatcgcaacaccgtctttatcatatccacagaatactaaatcatgtttgtgatttttaaaatattcaacaaaattcggatatgtattttcataatggctagagcttgtaacaatttgatcggtagtaaactctttgttatattttttatatgtatccttgattccttcaataatttcatcacttttaattaaattttgttttggtaagatatagacaatgtcatctttacctttagctagatatttatcaacaatctcctcagcagcttttttaacatcaatataaatagaaccaatgttttcaccagacatttttgttccgataacaacgataggtaaattatacttcacaatcgattcaacagtttcgtcaatattatcattattaaataagattactccatcaacacgtgactttactaatctttcagtaacatcagcaactgtattttcatcaccaatatcatcagtcgtatacatattgatattataatctaaatgtctaccagtatcgccaattccaccaatcatatctttgacatgagcaaatagtgattgtgggaaaacgattgcaattgttgttgttttgctagtagccaatcctctagcaatatcatttggtttgaaatctaaacgatcaataacatccaagactttttgttttgttttttctcgaacaacatttgaaccgttgattactcgagaaacagtcgcaagagaaacaccagcttctcttgcgacatcataaatagttacttttttcattaatcttttagatcctcaatgatgacatctaattcatcttcaatatcatccattgcatcatctaattcttgtaacacattaaaatctttgtcttgaacttttgttttgatttctttaaattttgttgtaacctcatcactaactttagcaaccgattctttaaaacttgcgtattcatcactagattttaccgaagttgctagttgttctaatttagttttaatatctcctaatttttctcctgctgtatctttaaattcatcaacatcaaattcatcaattgctaatttgatttcttcgatagtattgttgatcaaagattcaacatcatctttagtcatgttttgagctttatcatatagatcttgagacttttcttttaattcacctcttagctcactaccttttttaggagcacataacattccaattactgcaccgatacctacaccggcaataaattttcctaatttcatcattatttcacctttctaaaatttctttttgaacaatccaataatagcacttataggattaaacttaggtcgatttggatcaaagaaacgcgcgattgtttctactggcgcattcaaaagatctaacttgtaagttatatcatccataattttatccgctttattaattgtgctttgagccatttcgactgtgttccccacttgtttaactgtggttgaactacgaagcaataaaattcctaagctaactaaggcaaatgctccagaaagtattaaaacacagtaacaaacatcaattgcagtcatagcattacctcaactttctacaaataattataccataattctagatacttatatagatttttttatcgcgataactttttcttcaagtttataaatatctttgctagacataaacaagaacacaacattatcgaacttagctaattctttagcagcttcttcatcttcaccaataactcttgctcttggtagattattagcgatatcataaatatctatgtcaattccttcttctttcactgcattttcgggaaatggacagaaatatggataatcagctaaatccatagatttggcaaaatcaacggcaaaacgagcgccacgtgaaaaacgatcaggtttaaaaattgctacaatttttttactcgggtatctaacacgggttgcttcaattacatacttaattgcagtgggatgatgggcatagtcatctacgtaaacattattccctacttcagttacactgtatcgtcgttttgttccctcgaaagttgccattctattttgaatataatcattagtcatattttctaaataaccaagcgtaatgatcgctaatgaattatacaacatatgcattccaaaataaggtaaattaaaatgaccaaataattcattatgaatatatacatcaaacgataaaccattactgttttcaagcacatttaccgccctaacgtcattatagtcatttaaaccaaatctcataactctttttttaaaatttatttttttaatgtttggatcatccccccaaacaattactgtatcttttacttgattagcaaatttttcaaaagactcaatataacgctctaaatttccaaaataatcgacatgatctaattcaatattattgataatcgcatatttaggataataatgtaaaaaatgatcttggaactcacatgattctgcaataaaatatttactatcttttactgcatgaccagttccatcaccaattaaaactgtagttttatcaaattcttcaaacaaatgataagccatccctgttgtcgttgttttgccatgagttccagctatactaattgagatgaagttttccataaactctcccaaaaattcaaaatatcgataacatttaacattcggattagctaaagcagctttaacttctgtgtgatcatcaccaaaagcatttccaataataactgtataaccatctttaatgttgttagcatcaaatgaatagattgggatatttctctttcttaattcctcttcaatgaagatgtatttatcaatatcgcttccacacacttcatttcctagttcatgaaggatttcagctaatggcgccatccctgaacctttaattccaataaaataatacattctttatgtcacctcacttcaccattttagcacaatttaagataaatgtattgaccgaaccctaaaaagtatgtttttttattcgacaagaaaatgattaagagctgtaacccttaatcattaaattacaaataaatcctttggataactatttaaaactttacagccatcttttgtaaccatgactaaatcttcaatccgcaccccaaatttacctggcaaataaattcccggttcaatcgaaaaaatcataccttctttaacttccaaatcaaagttaacagaaacatcaccaaattcatgaacatctttaccaatgaaatgacccaacctatgattaaattctttgccatagccagcatcagtaataatatcacgagcagccttatcaatatcacaaagtctaaccccaggtttaatcattgcttcagctgtttcgttagccaaacgaaccaaaccatagacttctttagcttcttcacttacttcttgatagaagacagttcttgtcatatctgagcaatatccgttatacttacaccccatatcaataatgatactgtcacctggttttaaatggctatcatcattttcatgatgaggattagcaccattagctccataagcgatgatagcatcaaaactgttgccatcaccaccaaatttgctataaataccactcaatttaccggctacttcaagttctgataatcctaaagatacttgatgaatcacttcatgaattgcttgatcattgatccgacttgcttcaatcattaaaacctgttcattttcatctttaaccattcttacaaaatctacacaaaatgagccattaacaaatttaacatctggtagtttttccattaaacttaataaaaagtttgcactccaatgtttatcaactccaattgtaccagaattttcaacataatctgcaattgtttttgtcgcatcatcagtatcgctatgccaaacaatttcaatccctagatcattttctacaaagaataatttattgaagaacaacttatgggcaccatttgctgcaagcatcaatacatacattctttcaccggggttatttacataatcaatcaaataatcaattgaagaaggttcactgatcaacaaataatcaagaccagcttccttcatattatttacaactgcatcaattctattcttgttcatcttcaatcaccgcgattcctaattcttctaattgagcattatctacctcacttggtgcttttgacattggacatactgcacttgcattttttggaaaagcaataacctcacgaatattttcactaccagtaagtaacattgctagacgatccagacctaaggcaaatcccccatgtggtggagtaccgtattgaaaggcctcaacaaaccagccaaattgactatcaattctctcttgggtaaaacctaatgctctaaaggctctttcttgtaattcttgttcgtagatacgttgtgaacctccacccaattcaaaaccgtttaatacaatgtcataagcatcagctaaacaatttgcaggatcgttttcaattttatcaatatcactatctttaggtcgagtaaatggatgatgaaccgcataataacgttcagtttcatcatcatattcaaacattggaaaatctacgacccataaaaatgcaaattcatcagggttaaataattttaattcttttcctaaatgattacgtaaagctgccaaagcatcacaaacaacattatatttagcatcgctaacaaataataataagtcattatcacttgcatccattgcttttaataattttgtcatttgttcttcgttaaagaatttagcaattggtccctcagcctttccagctttaacttttaaccatgctaatccttttgctttatatgttttaactacatccgtcaatttatcaattgctttacgagaaaaattgtcagcttcacctttgacattaattccttttacatgcccatcagcttctaacgcgctcttaaaaaccataaactcaacatctttaaccacttcatttaaattaactaactctaatccaaaacgaatatctggcttatcaattccatatttttccatagcttcatgccaagtcattcgtggcaatggcagttgcagttcaattcctttaacatctttcattacttgtgctaacagctgttcaccaatactaataatttcatcagtagtcataaaactcatttcaacatcaacttgagtaaattccggttgccgatctaatcgtaaatcctcatctctaaaacagcgtgcgatttgataataacgttcaaatcctgaaaccatcaataattgcttaaataattgtggtgactgtggtaaagcataaaatgaaccattatgaacccgtgaagggactaagaaatctcttgctccctcaggagtagaacgatttaaatagggcgtttcaatatcaataaattcatgattatctaagaaatttcgaatactgctagtaattttatgacgcataattattttattctgcattaccggtcttcttaaatcaagataacgatattgcattcttgcatcctcacttgcatcagtatcatcagttgtgtaaataggtgttactttagccgtattgataatatcaatttgagcagcttcaatttcaatatccccagttggcatattaggatttttagaacttctttcaattactttaccaactacatgcaggacatattcatttttaatatccttacctagagcttccatttcttcatttaatacgatttgcgtgattccataacggtctcttaaatcaatgaaaaccaaagaacctaaatttctttttttagcaacccagccttttaattcaacaattttattaacatcactaattcttaattcaccattgttatgagttctattcatgtacatgtccctccatatgattttcaatatacgcaacaatattttcaattggtacaatatcttgtgtctttgaatgtgtacatttaatattgactacttcgtcagcaatttcttgatcaccaatgatcattgcaaaatgactattcaaacgatcaaccgttttaaactgtgcttttaaagaacgaccttgatagtccatatcaacactaaagccatttgctcgtagcattgccgtgatctgtaccgctaaatctcttgcttcatctcccattggcataacatacacatccaacccctcaggttcttctaattcttcatccatagcaatcaataatcgttccattccaaaagcaaatccaactccaggtgcttctggtccccctaattcctgtactaagccattataacgaccaccgccaccaacagtggctcctgcacctaagcgtggatcatcagatattacttcaaaaactgtatgacagtaataatctaaaccacgcactaaatttgtatcaacaacatattcaatttctagatcatctaataactcacatactttggtaaaatgtgccttagccgcttcacttaaataatcaactgtttttggcgcatttgccatcgctggatgattatgatctactttacaatctaaaattcttaacggatttgcttcataacgatttttacaatcttgacataaatcatctaaatatggtgcaaagtgtgctttcaaagcttcacgataagcatcacgactatcaccatcaccaagagtatttatatgtaatttgacaccttgtaaccctaaagcctcgactaatgttactgccattgtcatacattcaacatctaaatatggtgattcataaccaatcatttctaccccgaattggtgaaactgacgttgccgcccattttgaggacgttcatatctaaacattggtccaatataatataatttactaattttatcaggattagaaaacattttattttctacataagctctcgcaactccagctgttccttcaggtcgtaatgtaattgaacgcccctttttatcagcgaaagtatacatttctttacttactacatcagttgtatcgccaactgcacgagtgaataactcggtgtgttcaaaaataggagttctcacttctttaacattataattagcacatattgttctaattagttgttctaatgtttgccatttagcactcttttctggcaaaatatccactgttcctcgtggtgctttatacatcatctttcatttcctccttgataatataaaaacgcccttaaaataaggacgttagttaacgcggtaccaccttaattcgtgttaaataacacgctcttatgtcttaacgcgacagacgtttactcctactagatttcaaagtaactcctcccaagtgtcccgtaatgatcctttaaatactttcaccagacgtattctctctataaaaggatttaactacttaatcttgttcattggattaaattgattatatataatatttcataaaattgcaataactaatgaataacccgtttaatttcatagattccctgaatccgatcaatattatcgattgcttgttgtaaacgactagcatcttcaactgaaatctttaatttaatgattgctttcatatctacaacatcagcatggatattcaaaatattaattttcatctgccctaatgatgttaccacatcattcaataaattaggtcgatccaaaccaactatttctaaatctgcttgaaatttcatcgttgaaatggatgcaaaatcccaataaacatctatcaatcttgctttgatttcaggctgttgaatattcgggcagtctcgacgatgtactttaattccctgaccttgtgagacaaagcccataatatcatctccaggaattggattacagcactttgaaagttgaattcttagtccatctaatcccttaacaacaacacccgaattattacgcgaagactgctgtttttcatttacctgattatttcgctgaagcattttcgaaatactgtcaaagaaccccgactttttaggtacaactcgatccagcagattcattgccggtaaactttttttaccaataaaatataagatatcatcaaatgagcgggcaccaaaagaacctaagtatgttttatacgtatctggatccatatatttcttttcatctaattggcgttttttcaattcatcacgaagcattttacgcccatcttcaattgtctcttttttagtttctgcctcacgattagcaataaattgtctaattttattacgcgcacctgcagttcgaacaaattttagccaatcttcactaggtcctaatgactgcttattagttttaatttcgactacatcaccagtatttaatttagtatcaataggcaccataacattattaacgatagctccaactgctttatgtccaacttccgtatgaattcggtaagcaaaatcaattggtgtagaaccattcggtaactctacgatctttccttgcggtgttaaaacataaacattggcctcaaagatatcacgctttaatgaatcataatactctttagcatcaccgtctttaatatcgtcacttagagaaataaattctctaagccactgcaatttttcaccaatttcttgttgttctttcttcgatgaatagcctttattttccttatagcgccaatgagctgcaactcctaattcagctagctcatccatttcttcagttctaatctgaatctcaaaggtatttccatcctcaccaattactgaagtatgcaaagattgatacatatttggttttggcatagcaatataatctttaaaccgtcctggaatcgggcgatattgatcatgaatcaagcctaaaattccataacaatccatcttatcttgagtgatgatccttaatgcatataaatcataaagttcatcaaaacgtttcttttttacaaacatttttttataaatactatagattgatttagcccgtcccaagatacgatactgatagctattatcatccaatatttgtttaaccgatgccatcatttttgcaactgattctttccgttcttcttgtttagtcgctaataattttgatatctcgctatatgcaacaggatcaagataagataggcttaaatcctctaactctgttttgatatcattgattcctaaacgatgagcaattggtgtataaacttctaacgtttctcgagaaattcttttttgtttatgaggtggcataaattgtaatgttcgcatattatgaagtcgatctgcaaatttaatcaaaataacgcgaatatcctttgccatagcaatataaattttacgatgattttcagcataaacatcagattcatctttaaatggcattttaccaatcttggtaaccccttcaactaacgtagtgatttcctcaccaaaacgttctaccatttcttcccgagatactccacaatcttccatgacatcatgcaaaagtcctgccgcaatagtagcgggtcccgtttgtaacgttgccaaaatatatgctacccaaatcaggtgaatcgtatacggttcaccgcttttgcgtttttgcccctcatgcttctccataataaaatcgtatgcctgattaattaaatcaatactttcttgatttgtaatatatttaccacacacttcaagaacatcattaattgtaactgtatcgccagcacctttatattcagccataatgtcaccccctcttattattaaaaaagagatttaatctctttttagtatttcaatattgaatagatattatacccttgaagtttatcacgtccttttaatccttcaagttcgattagaaaagcaattcctactacctttccacctaatttttcaactaattttacagttgcttcaactgttccaccagttgctaataagtcgtctacaataataacattttgccctggtttaatactgtcagcatgcatgtgcacttcattagttccatattctaaagcataagtttcacttactgtttcacgaggtaatttacccggttttctaaccggaacaaaccctgcatttaaattatatgcaacgggacatccaaataaaaaacctcgagcttctggtccagcaacaatatcaacattagtatccagacttttagtccactcaacaaatcggtcaatcgtttctttaaaagcttccttatcagccatcaacggtgttacatctctgaaaataataccatcttcaggaaagttttcaatacttgcaacatacttagttaaatccattctatttcctccacataatatcctatgatatttaattataacatttttatactttaatttaaactatttaatatcttcaataattaagttgacagattcaatattattaaaaacattaatattaaacttaccaactgcattgatcattttagtatcttttaattgttcaaaaagatctccatgattaaaaaataacgcttgtgctttgacttgcggtaatgacaaatcaaaacgaatatgtttaccattcgataacgacgtaactttacttactggtaaatcttttatgaaaaaacgcatttcttcattgccattgcctagtggctctaataactctaattgttttacactaactttactaatctcatttcctgtaacttcaattacatccactaaaggaggagtataatcttttaattgtttatttaaatacaattctaatttttcttttagctcctcaactttatcactacctacactaaatccacctgctaaagcatgaccaccataactttctaacaaatcttgaacattttcaaaaattttattcaacggtatcccttcaattccacgagcactgcctttataaagatttttttcactatcaaatgtcatcacaaagctaggtcggttatattgtcgagtatattttcctgccactaaaccaatgattccttcgtgtatttcattttgataagcatataaaaattgctcattcgggtcaatcattgttaaaacgctttgatattgtttatttgttaattcttgtcttttagcatttacttcaattgctttttcactaactgcttttaatattccaattgaagcatcacttctaaaatatttaacgagatgattaggattaataatttcacttaagcgaccaaatgaattaatcttcggggcgatgataaacccaatactagtaacactataggtctgattactccccaataacaattctaattgaggatatttattttctttcataaattccaatgctctttttaccaatgctcgattttcatcaagtaatggcatcatatcagaaattgttgtaatagctgccaatgaaaataagtatttatcatgcttttttaataatgcacttgctaatttataagctacaaaaccacccgagatttctttataaggataatcgggtgagatttttgtatgaataatagaaaaagcatctggtaattcatcatcataattatggtggtcagtaacaataacatccactcccaattcattagctttttcgattgcctcatatgccttaattccattatcaaccgtaataattaatgtataccctttatttgccatttgttcaacacgatttgcatttaatccatatccatcttctaaacgactcggaatatggtatcccacttccactcctaattgtctaaaagcttcaactaaaattgatgttgctaaaatcccatcacaatcataatcaccgtaaatacagattttttctttattaccaattgcctcatgaattctttctaatgtcatttctgcttcagaaaataaagaaaaatcatgatatactaaacgacttgataacattgtttcaatttcttgagatgaatattgtttatacgcaaaaaccttagctaaaagtgcattaatcttgtattcttgcatatagtggttgtagtctaaatcattaataatccgccaatccatataatctcctttcaaagaaaaatagttgccttagcaactattttgaaataaagtccgaaaaatcatttatactcaaacgagatgcttctttaactacttgtaaactcagataatcaaaaatttcagaaaaatctaaattcatgatatcatcaattatttcacacatgggaacggcatctctttgtttccatttgcgctcaaataagtagtctttaatttgttgttcagaaatattatgaatattctgctgtttaaaatcacgggcttttagttttattaaaaaatttaggtcacgtttattaaatttaaaatcattaatcgattccattttcagccctccattcaaaagtcacttacatattatatgacaaatttcaccagaaaggaagtgctttatgaaaagaaaactaataaattcttttatcattctttccgctagttcagcaatcacaaaattgtttagtattcttaatcgcatgattttagcgcgacaattaggacaagaagcgatggcactatatatcttagtaatgccaacggtttcattatgcattaccttaggtcaattaggaattccttcagcagtctttcgacttgtagcaaaccctaaatataataataaaaaaattgtcatctccggtttaacgatttgtctttttacttgtataattgtcatgagtgccttacttttttcatcgaaatttattagtcataaccttttaaaaaatgagggtgctttctatcctttgttgtcactggcattgtttattccgctcgtagggattagtggaataattaaaaattattttttagcgaaacaaaatgtctttttagttgctaaagctggctttgtcgaagaagttgctcgattaagttttagttatttaatgattagacaattttctttcttaacagatacctatctagttagttttgcaacactggcaatgtctgttggtgaattagcatccatcctctatttgacaacccgtctcaaggaccatcatattacaacctttaataagcagagtattgtcaataatttgcaaattaaagatatgttaaatatcgctatgccattaaccggttcacgtttatatcaatgtttagttagctttctagagccaatcatcctcgtctatgttttaaccaaattcggtttaaaagaaagtatgatccatcaacaatatgcaattataagcggttatgtcatatcattattagttacacccactttttttaatggcgtaatttatcgcctgattctcccgatcatcactaatgatgtagtttatcataaaatcagcgctgctagatatcatattctaattgctatgattggtagttttttaattagtctaccgtttacattgattttttatttatatccagaagtttgtttaaaaatcctttatgatacaacaagcggagctacttatttaaaatatatgtgcattccattcactatcttttatttagaaacccctcttagtgcactgcttcaagctttgaataaaaatcgtttaatgtttgcaatcagcatcattcaatgtactttagaaatagttttaatatattttcttagtcagtcactaggggttttcagtatagctgtcagtatgttaatcggcattgtcgttgcactatttattaatatggtcgcttgttataaatatctatttatcgataataaaaaagcttaaagaataaaattaagcattttctttaagccattttgaaaataattgtaatcctgtttttatttcgtcactgttattagcaaagccaaaacgtaaatgatattcttgatcaaaacatgcccctggaacaaaaaacactcctgtatcctgttgtaatttagcacaaagttccctagactttatcgaaagatgatattttaaaaaggctattgttccagcttcaggaacaacgcaatcaaccaatggctcttgagctaaccaatcaatgagaatctgtcgattagtattaataatttttctacttcgttcaagtatcttgtgataattttcaataactaaagttccaagataatcgttaagataacctgttgaaataatatgataatcacgacgatcatttatcagtttaattacttcataattagcttttacccagcctaaccgtaaaccagcaaatgatgtaactttagataaagaggctgtagatatccctttatcatataaatcactgattgcgacttcaccatcacctaatccttgatacacctcatcacaaagaatatataagtggtattcttttgctaaatcagtcaaattttctagaaactctctagaaaattttgtacttgttggattattaggattaacgagacaaatcatttttgtattatccttaattgcattttcgaaatcacttaaccgaggtaaccaatcattttcctccaacaacggaataagcgtagtttcaacacctaatgattctggaaaagaataaaattgttggtatgtcggtgtaatcgtaattaaatgatcaccagcttcgagcaaagaaattaaaaccatctcattagcattgatacagccatgactaatcgtaatgttatcggcatcaccattttggtataatcttgcaatcccttcccgcaatctttgactaccaacaataggtccatagtccaatttagtatttaataaattatcaatgactccttttttattttcaacaaattctaataaatcattaatactcattgaagctacacaagtttccgccaaattatatcgatagttggtttcatattcagtcatccaagcttcaacatcaaataaatcaattttcattaatgcatcaccttacttaagaaatcttttgcacgctctgattttggatgtgtaaagaaatcctccgactttgcttcttcaataatttttccattttctaagaaaatcacacgatctccaactgttcttgcaaaccccatttcatgagttactaccaccattgtcattccttcttttgctaattcctgcattacttccaatacttcgataaccatttcaggatctaacgcactagtcggctcatcaaacaacatcacttccggtcctaaacatagtgctctagcaatagcaacacgctgtttttgcccacccgataatttatttggataaacatcttttttatcactcaatccaactcgttttaacagctctaatgctttttgattcgctgcctcttgttccattcccaaaacctgaattggagctaatgttagattttctaaaactgttttatgtggaaaaagattaaaatgctgaaaaacaaatcccattttgctacgaagttctttaaatgcttgagggtttttagcattcaatggctgctcatttatgaaaacagttccttcttcaggaatttctaatccattaatacaacgtaacactgtacttttcccacttccactaggtccgatcaaacaaacgatttctccttttcttatttctaaagagacatcattcactgcttttaaatcgttaaattttttagtaatatgctcaactttaatcacttacagataaccgcctttctatctttctcgcaaaataagatgttgttaaggtcataattaaatataatacagcagaggccaataatggcggaatcaaattaaatgtattcgcccccaaaatttgtgctgaatataataattcagttgctcctagaaccgaaattagtgatgaatctttaattaaagtaatgaactcactaacgattggaggaatgattcttttaaacgcctgaggcaaaatgattaatttcattgtttgtgtataatttagtcctaatacttcacaagcttcccattgacctttatcaactcccataattccactacggatcaattctgtcgaatatgcaccactattaatactcatcgcaatagcaccacaaacatatggatcaggaataaatctttccccagtaatcgaacgcattaataacggaaaagcaatatagagaaaaagtatttgtaacaacatgggcgttccacggatcaattcaacgtaaacatttccaataagtcttagtattttatgttttgaaatttttgcagcagcacctaaaaccccaagaataaggccaaaaaacaaagcacaagcggctagtaataaagatttaccagccccttgtagtaaaaaaatcaaattgtctgctgtgcaaaaagcaactaatgcatccacgtttatgctccccacttagtttttaattcttgatatttatctgatttaatgaattcagcaagtgctttgttgatgtctttaattaaatcttcacttcctttattagcgatgattaaattttcttcttctaataaagtttcatctaacatcttatatccgccttgttctacatagtttttagcaactgcttcatctaagatgattgcatcaatcccaccagaatttaaagtttcaattaaaactttaacatcttttactgctttaactttagcatctttaatatcattagctacactttcaccagtagcagccaattgagctccaatatttttaccctctaaatcagctttagtagtaattgtactatcattagcaactaaagcaacttgtctagaatcattgtatttgtctgaccataatacatcccagtctttatgcattgtaaatccagaaattcctaaatcaatttgatcagaaatcagacttgtagaaattgtatcaaatgacatttgtttaaatttatattcataattaccaccgttatcattcataattttaaacaactctttagtcatatcaatatcaaatccaaccatatctttgccctctaaagactcatatggtggataatctggagaaatcccaatcaaaatttctttcgtaccatcactaccgctgtttccgccgcaggcagcaagtgtaaatgccatcgtacatactaataatacttttaataatttcttcatttttcttacctttcctttcctatccttgcgtaaaataaaagtctcttagctaattaaaagctaagagacgaaatttccgcggtaccactcttgttgatataaaaagtcttatatcccctcttgtctgtaaagtagacatactgactgccctactattagttcaaacagtcctcttcaaagtgcggttcatttaatcttgtttactgaccttccaccaacgccagttcgctaagaaacttaattaaattactctctttatcaacgagtttttatatatacctgtattatatgaaaaaataatcttatgtcaactgttttcggttatttttgaccaagaaatttatgattaaagttatcaatatgttcacatatcttctttagcggttcattataagattctaattccattaatgtagtatctaacatttcattagtttcgttgagcatatcaatattttcttggtactgtttagttcgactccgctttttttcatcactacgtagcaatatcatacagccaataattaaaaaagccaaaatacctgctatcattaaaatccattttattagttccatttttcatcacctactagtagtataccacatttagctaatctatccatccaaaatgtttacaagcatattcaatcccatcttcttgattagatttagttatatatgtagctacttcttttacctcatcaattgcatttcccattgcaattgaaataggtgcttgtcgcatcattgaaatatcattatgtccatcaccaaaaacaactatatcttcaggttttcctccttgtatttcaatcattttcaaaattccacgatatttttccaacggctcaacaattaattgatcaccatgatatcgcatataaccaagtttatggattgcagtcaactcagcttcctgcttgtgtgtagccataataaaaatcttataaatattatcaacccgatgaaaatcaatctgtgggtctacaataatttttgtatgcattttaaaattacttagccactcattacatgtatatagttcaggaacatcccctaaagatacaccgaaaggaaatttcttttctatgcactcatcaattatttctaaacaaatatttttatctaatggttcaattcctagtaattctccatttatgactaaaccatttcccccatcacaaactagattatcaatttttgattcatgactaaaatccattgccatccagtgcgctcttcctgtcgcaattgcaacaaaatgaccattttttcttaacttatctaatgtttcaaaagttgagggtaaaataattcccccaggattactattagttaatgttccgtcaatgtcaaaaaagaaatattttctcatatataattccactccctttagtacgcaactaataatctcaattgcctagctttgctaaactagcaattaacaggcatgcataccttcctttccaaattaaaatatagttattttttaattcaaattatttattagtatttaaaaataacccattatttattgtacattgtttttagccggctttactagtatttaattaattatagagtagctttaaactgattttttattcgtgtataaaatttcttatcgtcttcatgatgaatatatgcaccatttttttattggatttttaatgaagctagattatttttatggactgacagatatattttatcctctttaataatatttttagctatttgaagagttacctttaatccttcacagtatgcccgtttcctctatattcttttttattacatatccgatatgtccggcaccatgagccaacttttcagtcaagtaatgtccaatcctaaatcagtcaataatttgatcatcttccataaaaacacttctgtttccggaacccatccctcaagaagtccaatcccgttggaagaattaatataacctggcaaaattttattttcaaaatcatttttgtcttctagaacattagaaacatactcatactcttgctctaatatctgccatatttatcttctttgagtacaacatttctaatctcctttttcttaaattactaatcttatttgaatcaaaaaatatagttaataataatttttaagcataatattttatctataaagctcattttaattcgatatggtcaataaaattaagtggtagatcacttaaaatatctagagcccaacattcccgctcacgttctaataacgtaagtggtgaatgagcatcatatccaaaagttactttacaaccatacatagcaattatctcccaaaattcacgaaacggatatggataacatgcctttaattcattgtttatataatattgtttttttccatatccaaaaccatttagattaatttctaacggtgtatcataacggatgctagcttttgctattcgatgcgccgcatcaacacaagcatttgaaaaactccttctccccatcataaaatagtcaggatgagctacatatgtaataaaatttttagataatgcctcctctatttgctgtgcataaacatatacatcctcatcagaacaataactgtcatagtcataaattaaatatttaaaatgttgtcccaaaatcatataatcacattcttttttcaaattcatcaaatcattaaaatgatcttttaaatactcaacctcatagccaactttaatatcaatcttatcttgataatcttgttttaattttcttatcgttgcaatatattcatctttttgctcataaaacattcgtgccccagaaatccgtatttcaggataaggcagatgttcgctaaatcctaacattgtaaatccagcctcaattgcactttgaatgtattgaatatctagtccagttgcatgcccacatcttgttgtatgcgtatgaatattccatttttgctgcttcattaaaaattcccctttctaactaataaatgtgaaatttatttagtattttaaataaatattgtttaaaccaatgtactataaaataatattaggaatattataacatatttcttattaaataaatcatcctgtttctcaaaacaaaccaaaacaaaaaaagccactatatacagtgactttttagcttaagtataaattattcttcttttttcttcaatacaatcacactgccagcaaaagccaataatcccgctaaggcaaatgttaacatcatagaatcatcacctgtttttgtcgcagttatagcaccattacctggtttagcatctggtggtgtttgagcatttggatcatctagagtaatttctttcactaccaaattgtttaatgctgttttcaataatatttctacagcagttacttcatcttgggttgcttcgttattatcaagaactgcttttgcttctactaatgcgctcttaagcgataataatgatactgctgtatattttgtttgatctgtattttcagctttattgatcaacacacttaacaaatctttatttggctttaatcttaattgtaaaaaggttcttactaattgatcatgcgtttcacttacttctatttctaaagcatcaggattgttcaaaacatcttttgccgttgttaagacggattctaaatttttccatgttgcgcttaaataatcatttttgtttaatttttcaattttttctactaatgcacttaattgtgttttatcgcccttatagaattccaacatttgcattacattagataagcgttcaaaagctttatttatttcaagttcatttgcatcctttttatcaaaaattatttgagcattttccaatgcagccttaaattcagtcaccacagctggtacaaccttatctaactgttctggtgttacttgtttagccatttcaagagcagctgataattcttttttatttttctcaagtaactcattttttgctttttctaatgcttctttagctaaatcaacttcatcttgtggtacatttccatcatatatagattcagcattttctaatgctttttcaaaattttgccaagtttcaatagtataatgatctttatctaatttcttcgcttcggcaatcaaatctgataaagcttttttgtcagatttatatactaataatgataaaaccgtattatatttatcacgtaaatctgtttcattttcatcaacaacagactgtgccaatttatgagtcaaattaacattttcagccgtttgcaatacgacttttaaagtatttaaagcttctgctgctgcctcccaagactcagtagtatatacacttttatctatagctttagcttgtgcaatcgcatctgctagtccttttttatctggatctttagcaattgcatcatattctataccatatcctaattcatagacattttcgtcagttgaatatactccagattttggaacatattttgggatatctaccggtagtttcccagaagctccaaatgtacctaaagctacttcagtacctgctgtcaagttaggactaaatgctgctgttgctccaactgtaccaccaccgaatgattccgtaatatccagcccaagactagtagttccatacactgctaaaataccatcagcatctgggaaggcttgaacatcataaggatgatttaatgaaataacaaccgtctgctttccattttctttacaatacttagtaaataattgtgggcaagctaccaaatatccatctattccactagcactactgatttctgaggcatggacaagaacagtaccccaatctagcacatctttatttgtcccaacaaaattagttccgtcagaatttatagcactgtttaccttatcgtttaatcctgtccaattatagtgctgcaaaatcttataatctgccccctctggaataattcccgcctgtttagctctttgccaagccaaaataaaacgattattattccttgaataagttgatgcaaatactacttttgaatctttagtcaatttaagtggtaatacattattttcatttttaacaacagtaactgcatttgcagaaattaatctctctgtttcacgattttcaacagaaccaaccactttcgaagcgattgcttttttatcatctaatgtagttgtatcatttgctaaatccatgacatctctgttgtatttacaaactaaaattctttccacagatttatccaattcttctaatgataatttaattccattataaccatcttctttagtataagcatcgacaaatgcattaatcagtggaattaatttagattccatatctttcatagaagaaatatccgtaaatggaatatctagaatatcaactccagctttaacagctaataagtttctttcgtttgtatcaaagtaattagccacaccttgcattgtcatagaatcagttacaatgacaccgtcaaacttcatttcatctcttaataaatcagttaaaatttccctagataatgtagctggcggactcatcagctcatcttttttatctgagtaaatttcttctgttacaatattcggaaattggatatgagcagtcataaccatatctgttccagcatcaattgccgcctgaaaaggtactaactctgttttatataattcttctttagtcgcaggaaccgaaggtaaacctgtatgcgaatctgtagctacatttccatgccctggaaaatgtttagcggcagttgccacattattgctttgaactccttcaatataagcagaaacaaatttagctgctaattgcggattactactgaatgaacgtaatccaataacggggttattagggttattatttacgtcagcatctggcgcaaaattaacatttacaccaaccgcatttaattcactaccaataatattacctgctttaacagcattttcagtattaccgctagcacctaaagccatatttcctggtaaggccgtcccaccagttaaacgatatacgattcctccctcttgatcagtagcaattaatagaggaatactgtttttacctaaatctttgtccattgctgctttttgtaaaccatctgtcaattctacatttacttttgcatcggaattaaagttagcagcaaataagataacactccctatatcatattcaccaataatctcatgaatttcatcgttaatagtttgaaccgatgaaattttagttccatctctcattgtccatccactacggaaagataacattaacttttgcccgattttctcttctaatgtcattttactgacaagttcccttgctttttctgcattggttagcgctctaacattagaaatgtttgcactaaatacagttgtaacagccattgataaagccataattagcgaaatgattctccttttccctaaccttttcatttttttgctcctttacccttctctagtctaaaataaatcaaaggcctaaataaattgcaacaagtatttgatacttgcggattattaccaagtactaacaatatttgttttcccttaatttttcacactccttgtccatctattttgtcatacttgattgaatcagtaaacattcattacttttaaaagaataaaacctaagtaaagcaagcaaaaaaattgctcatactaatacttaggctataattgatttaaaggtaataccacgtctatatacttatattctagataattatatagacaatgtcaatgacaactaaaaaataaagtcaaataaatgttattatttatacactgcacatacaacaccttaaataaactttaattagcttcttaaaattaacttagatacttttcttcaaaaacatttattgccaacggcttgctgaataaataaccttgaactgtttcaaccccatatgaacacagcgtaaaaaactgctcttctgattcaattccttccgctatcatatccacccctaatcgatgacaaatttttgaaatatattccatgattatcttagttcttggatttaatgcaacattactaattaagctcttatccaattttagaatatcaaactcagcatccgataataatgctaaattggcatactccgttccaaaatcatcaatagctacaataaatccagcactacgaagttttgatattaccgttttaatttcaaaattcttttcgtcatgtactcgttctgttatttctatttctatatatttagtaggtatttgatattttttacaagtttctaaaatacgttcaacaaaagatttaccacgaagtgattctatagaaaaatttattgaaagcggaattatcttcatttctttatctaaccaatattttattttttgacaaactgtatcaagaacgaaaaaatcaataagatcaactaattctatcccttctaataatggtaaaaagaaaagtggcggaattaatgtcccagcattatcacagtaacgtatcaatgtttctgctccaacactgagcgatcttcacataaaattttaggttgtagatagacaacaaaatgaccgttttcaatctcagattctagataatcaatattagtgagatgcagcatctcatcgctatggtgacgataccgtctggaaatcatatgcttatgataaaattcttttttattttcatacatccttgcatctgcctcagcaatcatctcattaatattacctactgcattagtccattgtgttcctatcgctacttgacaaactggttttttagaaaaactttcacttaattctttaactcgtttttcaaatgactctttttttatgctttgacaaataataataaattcatccccaccaatacgataaaaatcagcttttttaaataccattttcatacgtctagcacattcaaccaataatgcgtcaccaacttcgtgtccaaattgatcatttacatcttttaaaccatttacatctaaataaataattcccaatgaagtatccatattaaaaagtttttgagtatctttaatataacgattacgattataaaaggtcgttaaattatcatgataactcaaatatgataattttttttgactctctgcatgttgtaatgctaatgaaacgaaataacataatgtttgaagcaatgaagcaatattaataattttatctggaggtggattatcaactcctaaataacctgccagttcgccattttgttccaacggagctacactaagctagttattgactgactgtctagtatttcatattcttccaatgaaatttcttttatttcttctaaattttcaatgattacacatttatcatttttaaaataaggaatccaccgatcaatcattgcaagaggaattccttgtagggtgtttttttgtgatataatattttccgcacaccattcatagtcattatacattagttcatctttaatatagattatgtatgttctttctgctgataaaaaattcccaagctttctcaacacttcaataattgcagtactaacgccattttcacgatataatataccaatacattctgtaatcgttttttcagcctcaagtgtaaattttaactgctgtttttctatctcagattctgtagtatcaaaagcaatttccattcttgcaaccttaccatcccactcaattaaacgatcttttaacaggtaatgccgtttagttagcggattagtaaattctcaagtataattttcctcttctttcaaatagcagttagtacaaaattacaaggcgcatctcttccttgtaagactttataacattttttccatagattgaatcaacctcaaatattttcattccggtttcattaataaataataaatcataagtttctaagtcaacaatatataaaagttcagaaatatcatttaagggagcgcgcatgttttcagccagtcttgcaagttatactttacgttgtttattattttcttcctctttctctaatttttttcgtattttttcttgtttagtattatacttataaataaaaaacactagtattgctaacgctagattcaaaattattaatgttccttctgctgaatacacgctcttttcagaatacaattccgtagaatgtaccgtatcatctgccaactcaaaaaaggcttcactataaaaatataaattcccattatctctgccttctcgaaccaaataaatttctttttttaacccctcccaatcaaatttcatttgagtcatattttcttggaaatcatcagaagctaaacgaatcaaaccaagttcaccatgtccagtttgtagttcatcaataatatcatctattttttttcactaatttgtcatttggcttattacttaattcttgtttgatcaatcgttgcgttgcaccacgaacaacaccagtataattgataactctggcatttccttgaagattatgaattacataaatcgaaataatactagataacaatagtgacgtagttagaacaattaaaaataattttctacgcataaaggaatcctcccaaagaattatctttttacactttataagcagttatattatattttccaacagtataaaaagaacattcaaaatttaatcatgttcttttactcgctaaatattttaaaactaacctttatttataagtatactctattgcactcttatacgaaaatttaaccataatttaacattttttgtatcacactaaaaaaggccaattcggccatttttaaaatttgtatgtaacttaatcgattggcaaattcaataatttccagctcaaatcaatcatctctggttcatccatcgaattttttattactactttcccttcatgattttctttctgcaataatttttttcctgctaactgccgctttaattcacatgaagttccatgactgccatcaataatctgtattcttcgctctcctaaaaattcttttaaatacggtcttaaaaaggggtaatgcgtacatcctaaaacaattgtttcagtagtatcatttaaataagggacaagtgtttcattaaaatatgcttctaaaaagctcccattcaaatttccatgttctacaaattccattaaccccttacatgatactggtattattttggcacggtctttatagatatctagcagccggttaaacttttcttgttttattgtcataggtgttgccattactaagatttcaccaccatggtttgattcaactgctggtttaattgctggttcaattccaactattgttaaatcaggatacattattctaagctgtcgaacagctgcacttgttgcagtattacacgctactgctaatcctttgatccctaattttaataatttatcaacgatagcaaaggttaaatctctaatctcatctactgatttggttccataaggagcatttaaagaatcaccatagtatataaaatcttcatgaggcattatctttatcgcctcttttaaaacacttaatccccctaaaccagaatcaatgaatccaattggtaaatttctttcttcatttattttcattcgtgttctcccctttatctagcacttgattaacatctctaaaattaattgcatattagcacttgtatccaatcttgtaaagtacctttgaattaacaattacatgaatcattaataaaaaactcctttattaccgtataataattattaaaaacaagataatatatttgattaaagcaaattaaagccgttcataataaaaaatgaaggagtgataaaattatgccatatatttcaaatgtatatgcaagacaagtattagattcaagaggttttccaacaattcaagttgaagtaactacggaaagtggattttctggaagtgcgattgttccaagtggtgcctcaacaggaaaatatgaagccttagaattacgcgataacgatgatgcacggtatcgtggaaaaagtgtatttaaagcaataaacaatgtgaatgagactattgccaaattaattaaagaaaaaagtgtattagaacaacgagaaattgatttagcaatgattcgctttgacaatacagaaaataaagaaaaattaggtgctaatgccatgctggcagtatctttggcggttgcaaattgcgctgcaaactatcttgaaattccattataccgttatttaggcggttgcaatgctcatgtcttaccaaccccgatgatcaatattgtaaatggcggaagccatgctactaactcactagattttcaagaattcatgattatgccaatcagtgccaattctttctatcaagcaatggaaatggcaacaaatgttttccatactttaaaagatattttgaaaagaagtaatctagcaacttctgtgggtgatgaaggtggatttgcgcctaatctcgaatccaatgatgatgccctagaattaatcattaaagctattaaagaatgtaattatgaacctggcaaagatatttcaattgccctcgatgtagctgccagtgaactataccagaatggtatttacacaattaatggtaaacaatatacaagtgatgaattaattaaatattacgaacaacttgtaagcaaataccctattatctctattgaagacggtttagatcaagaagattatactggttggaaaaaacttactagtagactaggagctaaaattcaattagttggtgatgatttatttgttactaataccaatcggttaaaagccggaatcgcaggaaactatagcaatagtatcttaattaaattaaatcaaatcggtactttaagtgagactattgattgtattgaaatggctgtaaaaaaccagattgctccaattatttcacaccgttctggtgaaagtgaagacacttttattagtgatttggcagtcggtttaaatattggacaaatcaagactggttcgatgtctcgtagtgaacgtatttgtaaatataatcgtctattaaaaattgaagatgatcttgtcggtaattcatgttatcaaggaaagatcaataataaataatttatctcttaaataattcaattaaataacttaattagttttaatttaaaaatggtagcgatattatcaataacatcactaccatttttaacaaaaatataaattcttttataataaaatgttatcttcgttcataaaacaatcacttattccattataacttagtgatttaatcaactttagttttatttcataatcatgagtagtttcaaaaagacgaatttcctttcttaaaattgtaggaataatcgtcatatgataacgatctataaaatctttttcaattaattgtgaaatcagatttgtgcctccataaatccagatattttttcctacttatgattttaaaagatttaaaaattcgtaagcatcatcattagtaaatttaattttagctccattttcataatatttgtgtgtaaaaacataagtaatcaaattgtcatagacccacatctcaggtgacaattctgttacaatttgatgataagtattccatcccataattactgtatctatatctttaaaaattcttgattgctattttgattatctgaattaacaccttgcccatgtaacgccacatctccacgaacaatataaccatcaaggcgtattgcaacatataaaattatttttctcactaatttctccatttaagcatgctcttcacataaactgtttgtaatttacactttcaaaacattctattgcctttcatcaagatatttttctatttccgcaaaagttaatttacgcacttcagttcccgaatacttaatatatttatccattttaaatattagtgccatttctttcatactttatcactatttttctttagatactctttcaaataaccagtactactaaaaatcttataagaagttctccattattattttcaattcgatatatcacacatgtttttttaactataatcagctgtacataaatacatcttagcaatttcaaggcttttaaatggaaaagtccacctttataaccctcgtttaaatcacattctatacagatatttcttccacacgttccacaaatatactgagtatgtttttctaaacaaactagcgaatttaataatgacgtacagcgtctttcatccacataacattcttgacacatttttcttcctacttatttaagttatataaataatttatccatttcgaggaatttcttttagtttcaaaagctttgtatcccttatgactataaatatattctattttccattggcctgaacctacttgcttctcttcaaggaggttcttcaacggaatcgtacgttgatcccaccataaatttcgttcatttacaatatatactaaatctgtcaatgataacatatatgcttgaggaaacatgattttatcaatatatttactaatgcattgctgatttgataagcgctgatacatattgtgctttaacatatatacaattccctgttcaatcagttgttcgacatgagaatcagcatttttaatatatttagcataagtaatcaatgctcgtacagttttaccaatcccaatataacatggtgtagctttcatacatccgccatgtttgcaaatttctccatatcgccaagatgttctttgatttctctcaaatacttgatatctttttatccaatctagagcattctgtgcttcattactctttgccatttgcaatcgagtatatgcttctaaaagcattgcattgtaacaaggaacaatgcaatcaccttgtccattatatgaaaaaccttcatcagcagctaaattattagatataaaatcaatgattttttgagtatatggcaattgttcaataaatggtatttctgataaacaaataagtctaaaaatattaaagaaggaactgtcttcataatctcttgtcaatttttcaactaatttagattcttttaataattcagatatttctatttcagaaaaagcttcaccatgctcaaagctttttcttaaaatcaaagcactatctatagcttgttctttcattaaaattattcatcctttagccatttttttaattcaataaacacgttttccatcctccggcttgtctcaccaaataactcgttattgattaccggcagctcctcattgccaaaagaacgtttatctatatatgtttgataccacaattcaatttgaattgcctcacaattttcaacactggctccataatatttagtaatatagcctcctgcaaaaggattattttcagtcactttaaaattttgcttcttcatcatttttttaaagaaatttgtagttttagaagtacaagcacgaccattatcattaccaagaataatatccgcgccataattcaatccaaagctatgcaaatcaattaaataaacttttttaaaatatttttgcttctctagcaatgcttgtctaatcgcctcatgataaggtaaataataatcagcaatccgtctttcaatttcttgtactgataattcgtgattatacattaaagctccttgagtggtttttgtataaattagatttgtcttataagaactaccttttttatcattaatatcacgattcacatcaatcaaatgccggttcatattattaataataattgtgaaccctaattcttttaaaaagccatacagttttggtaaataccaatcagtattaggaaaaataacatcgtccattaaattttcagccatttcagaagttatatatgttccactatgcggtaagctgattactacaggcagctcatgcaacgatgtattaattgtatacatcgactgtttatcttttaatatctgtatcatactattcctctcatattttcccatcttaatttagtttaaaaaaagtgataactatattttatcatttacccatatgtagatcatcaacaagtagatgatgtgtttgaattaaaaatggtaaaagtatttcatcatcatattagaaatattttctctagtcgaataagagagtctcattatccttcttaccaaagttagtgtgtaatatatgttaatatggtatcctagactgtaatgaaaattaaaatacattatttcctagtgaatcagtaaatattcagtttgttcttttgccatttttgtagccaactggatatagtcttctatctttggctgtattgcaactatgactacttcaaataatccaatctctagctctaaatatgtaagggctgtgtcgatttgatcatatagaacgatttgaccgtcaaaaaatcagtacctgcatgcctctatctcacttgcatatttacttactgcataggtcaaaaccattgtgaatgaataattttgctctcaaattcttttttaaattcgcagtatctacttctaagttcagacaaaaacattgttcactactatctcaaaaaaaactgacaatacattgatcttttccaattattaggggcaattattttatataattccatcctatttctcctttaatcgtatagatacagtttactcttctcagctttttaacacaacaataatgatataaaaaagattatcacaatcttgttttaactatttatactgatctttaaattgttataaaaaaatagaagttctgaaataaactattcttcatttggagacccaaataactgagttcatttcagttcttctacttctatttattaaactgcattttataaaaggttgcatattggccattttttgccaataattcatcatgtgttccttcttcttcaattccttttgtagataatacacaaatgcgtttagcattttttatcgttgataaacgatgggcaataactaacgttgttcgatttttggccagtgattctaatgattgctgaacaatatgttcactttcattatccaatgcacttgtcgcctcatcaaaaattaaaattggaggattctttaaaaaaacccgagctatacttaatcgctgtttttgcccaccagatagtttcactccacgctgaccacaatcagtatcatagccatctggtaattccattataaaatcatgagcatttgcttttttagcagcctcaatgacttcttcatctgttgcgtcaaagcgaccataacgaatattatctaaaattgttccagcgaataaataaacatcctgttggacaatcccgatattttgacgtaatgaatttaatttaatatctttaatattttgtccgtcaataaaaatatcaccctcactaacttcataaaaacgtggcagtaatgagcaaatggttgtttttcctgcccctgaagaaccaactaaagcaatatactcaccaggagcaacttttaaatcaatgtcttttaacacataatcacttttttgattgtatctaaacccgacatgccgatactcaatggctcctttaacatctaataaattatgagcatcttttttatccttaatatcaggttcaatttccaatatttccatgaatctttcaaacccagtaatcccatcttgaaattgctcagtaaaattaataaactttttaactggatcaataagattattaatataaagcaagaatgcaattaaatcagctgtatttaatccatcattagaaataaaaatagccccaaagaaaaccgctgctacagtcaccatactagtaaaagcacctaatcctgaatgaaattttcccatataaaaataactatttttcttactgcttacataacgactattttcatcatgaaacttaataatttcatgactttcattcccaaaactttttaccacacgaattcccgataaattatcttcaattcgtgcattaatatcccctactctttgtttatttcgcttaaatgctcttttcattttacgattgtaataataaataaatgcacccatcactggaataaaagcaaaaacaattaaagttaatttaagattaattgttgctaaaataataaatgcaccaaaaaatttaataaatgaaataacaatgtcttcaggaccatgatgataaagttcagttaatgaaaacaaatcgtttgttaaacgtgacattaattgccccgttttttgttcatcataaaaactaaatgataatttttgataatgttgaaataattcattacgcagatcacgctccatataaacccccatcacatgaccttgatatgccacaaaatagttacataaatactcaacaataactaaaactaccataaaaatccctaatttatatatgatgcccatttcaaaattatcagctattaaaactgttcctgtaatgtagcgaataatcattggaaaaaccaatgtaattcctgcagcaatcattgcacaaaacatatctgctaaaaataattttaaatatggacggtaatacgataaaaattttttagatctctcactcattattcaacctccttctatactctttatttcaccatataataacatatttatccaataattttaagtattttatccaaatgttaagattgtgttaatttattttacaaataatttacaattacttaacatttctatattatgtttgtgtataggagtgtgattttatgacgttagcggacattgattggccgatgatacttgcaggtttaggattgtttttatttggaattgagtacatgggcgatggtttaaaaggatactcaggtgataaaatgaaagatatcatcgataagtatacttctagtccattcaaaggtatagtaataggtgcatttgtaacttgtttgattcagtcaagttcaggaacaacagcattagcaattggtttaattcgttctggtttgatgaccctcgaacaatcaattggaataattatgggtgccaacatcggaacagttattacgtccgtatttgtagggttaaaagtatctcaatatgcagtatactttattatccttggggcagcttttttaatgttttcaaaaaacaaaaaaacaaaatatatgggacaaatcatctttggatttggatgtttattctatggtttagagttaatgggagataatttagcaaatatttcaaaagtcccagaatttacacaagtagcgaattatctatcacaaaatccatggttaggattattgggtggaacattattaacaacagcagttcaatcttcagcagcggtaattgcaattgctcaacagatgtacggtgctggagcaatcggtttatctatcgctttaccattcctttttggaagtaacatcggtacaacgattactgccgtattagcttcatttggtggaacagtaccagctaaacgtgctgctttcttccatgtattattcaatgtggttggatcactattatttatgatcgtcttatcgccattcacgctcttgatagaatggcttgctggagcattaaatattttacctgagctacaattatcagtagctcatggaatctttaacgttgtaactacggcattcttttttcctttaataccagcaatcgtaaaacttatcaaaaaaatcttaccgagcagtaaaaaagaaataaatatggatttaagcgaattagatcaaaatgttgttcagttattcccgagtcatgctttagctattgctaaaaacaagataatcgagatgggtcatattacaattgaagcagttgaaggaattagagcttattttgaaactaaaaacccattagctaaagatggtgtttatgaaatggaaaatgctattaatacactagacagtaaaattactgagtacttagttttgatttcgcatgaaactctaaatgaccatgattctaatgactatttagcaaatatgaaaactattaaagattttgaaagaattggtgatttatgtattaacattgttaaatattatgaagcaatctatgatgaaaaagaagatttttcaccagaagctcgtgaagatctagaagcgatgatggatatggtcattgatatgttaaatcacgcagttaaagcctttgatactcatgatttggatgatattgtttatgttgacgacaaagaagcagatttagattacttcaacaaaaaagctaaacagcgtcatatcaaacgagttggtcgtaaaattgaaaattcagcactagttaattcaacttacgtcgatattcttgctaatctcgaacgaatgggcgatcattgtcaaaatatttctgaatcgtatttattagatgaatcagcctatcttaacgaagaaccagaatcagcgttttcaaagtaaaccgtgttttacacggtttttctttattgtttggataaaaaatgataatctaataatatatttataaggagtcgattatgaaattaagattaactaattatgatactagtgagtataaacaatttgaagatatgctaaataatttatcaaagtcaggctataattgcaaaagcgttgatatgtttacagtttttaaaaaagatgagcaacgtttctattataaagcagatatttttgtacctcaaaaaaaatcttctaaaaacaatcgtgaacagcgtgatcagtggttattaaattatgtaaaccacggttatgaatttattggtaaatcacgaaagatatatgtttttaaagccgctcaagcagccaatattaagggtacagatcaagcactgctgctaacttattttaaacgcaataagaccatctccaatattatttttatttttgtcgctatgctgctttcttttttactgattccaagtgtttttgctaatcaaaacccaatggaatttatcacgaacgggtcaataattttacattatattcccttattattttgcccagcattactaatccgtttcttcaatcatcatctcactactgaaaagatcaaactaactttaagtaataaaaaagcaaataataaaattagcaaatatccatttattatgtcaaattggttactaattgtttcaattgttttaattattgctggattttcaatcgattttatcgggcgtgagacactcccgcttaatgataggatcattacattatcagcacttggtctatctagtaacaatgatgaatataatacttttaataaaagcagcagtttaatgatcaaagaggcaataagttataatgaagaaaatgataatgatgctttgattgttaattattattactataattcagaaaaaaaagctaaaaatgctttgaacgattatttaaacagtgttaactttaaaaataaaaagcaaataaccaatggttatctgctttcaaatgattcaatttataattgcattgcttttgttaagaataagcgcttaatcatcgttcaaacaacagtagatcttcttgaaaacaatacttatcaaaaaattacatcatttaactactaaatcagttcaataactgattttttataatttagttaataatttgattacttcgtctattttctgatctgcatcatgctcattaatcgcatttttaacacaatggttgagatgattagataatacctcattattagcatttttaattagtgattgaatagctaataactgattcgaaatatcaatacagtaacgctcatcttcaatcatcttaataactgcatcaatttgtcctcgcgctgtctttaaacgtaataagactttttcattagacatttttaattcctaccactttataaccagctttttcaatagcatttttcaaaatactatcatcttgaactgtttcaacacgagcaagattattttctaaatcaactgcagcagttgtgtctgctaagccatttaaagcttcttcaacatgttttttacaatgttgacacatcattccttcaattacaatttcctttttcatcttcttattctccttttgatagtatggtttaaagcgttttaatcgtaacgcattagtaacaacacaaactgatgataatgacatgcataaagaaccaaccatggcatctaatcttaatccaaaactataatagaaaataccggctgcaattggaatccctatcacattataaataaatgcccaaaataaattttctttaatattaataattgttctttttgataattcaatcgatgccactatatcacgaatatcatctttcatcaagataacatcggctgcatctatcgcaatatcatttcctttaccgatagcaacacccacatcactacgaactagcgcaggagcatcattgattccatcaccgaccattaaaacactattgccctgtgcttgcaattgttggattacattttctttatcttgtggcaagacttcagcaattacctcatctaaacctaattgtttattaatagcatttgcagtaccttttagatcaccagttagcataactgttttaattttcatttcttttaaacgctgaattgcttgacgacttgtatctttgatatcatcaaaaatactcaccaaccctatcagctcttgatcatgagctaaaaatactaatgttttaccttgaattaaatataaatcaattttttcttgatatcgacttaaatcaattccactctctttcatcatccttaaattaccaactgcatattcaacattatcaattgttcctctaattcccaaaccacttaatgattcaaaatcagtaatctcttttaattctaaattcatctcagcagctttttgaataaaagcattcgctaaaacatgactagaacccttttctagcgatgcaatgatcgcaattacttgtgctaattctaatttgtgactataaatatcactaacttgagccattcctttagttagagtccctgttttatcaaaaacaactacgtcaatattattttcattttctaatacttctgcacttttgattaggatcccattagttgctccaactcctgttgacaccatgattgctactggagttgccaaaccaagagcacatggacaagaaataactaataccgcaattgcgctagtaatagcaaaattcaaatcttctcccattatcaaccatcctacaaaagtgattagggctattacgattactgtaggaacaaaatatttaacaaccttatcaatagttctagtcattggtgctttggaactagatgcttcttcaaccaattcaataattttggctaatgtactatcctcaaccgttcttgttacagtatatataaaagtaccttggagattatttgttcccccaatcactaaactacttacttctttttcaatcggaagactttcaccagtaatcattgattcatcaatagaactaaatccttgtactatcttaccatcgactggcactgtttcatttgcccttactagaaccaggtcatcaatttttaattcggaaattttaacaatttcttctttgccatcattaaaacgacaagcgacatcaggagccaattctaataacttcccaatcgcatcagttgttttcttctttgatttagcctcaagatatttcccaaaactaatcaatgtaacaatcataccagcagattcaaaataaacattatggactaaatgcatctccattaaagatccgcttaaagctaaaacaactgaataaatactatagacaatagcagctcccgcaccaagtgcaatcaacgaatccatagttggatcaaaatggatcaaattcttaaaaccattaacaaagtaatcttttttcaaaatcaaaattggaatcaaaaagattatttgtaatatgatattaaaataaacattatccctaataatattagggattggataactgagcattgatgacattgatacatacatcagtaatccaagtgcgatgaaacaataaattaatttccttttcaaattacttaagtcgtcattatcaactaatgcatcatcataactactcgcctgatatccaccatcttttacggctttaataatcatgctatcatcaacttttgtttcatcaaattcaacattcattgaatttgttaataaattcacctcaacatgttcaactcccggtaatttacaaacactattatgaacatgattttcacaagctgaacaagtcatcccttttacactatatttacgtttcataagacctcctcccccctcctagggggtacggatatagtatagcccaaaataaaattttatgcaaaagaaatgcacaaaaaaactattacaaaagtaatagttaataaaatcttgtaatatcctcaaccgttttacgtttaggccgttctggctcaatatcactaatacctatagcaataactgaaacaattatttcttctttagaaatatctaacaatcccttgattttatcaatatcgcgaatccccatgaccaatgatcctaatcctaattctgtcgcttttaaaagaatattttgattgtgaagtccaagatcataacagccccagccatttgccagttcgttactaggcgttccatcacgttcaaatcctgagcgatttggaatgaaagatgttactattaaaaccggtgcatctttacaattttcttgattaaactccggtaaacatctctctttaaactcattcaataaaggttgtgatgtaataacatgatatcgagctgtttgactatttttccaagatggtgcttcgactgctgcttgaataagcaattgtatctgctcgttagaaacaggcttctttttatattttctaatacttcggcgctgcttaataatttggtctaatgacattatttttcctccttactcattattttgattacctcttacttcaattataccagaatttatcagttcaataaacttatcaactaaatcgggatcaaattgcaatccccgattacgctttaattcattaagagcatactctaatgaatatggttctttataactccttcttgaagtcattgcatcaaaagaatccgctattgccataattcttcctccggccgggatatcttcaccagaaattcttcttggatatccacgcccatcataacgttcgtgatgtgttaagacaattggaataacgtagtccaatgaaggtaaatgtcgaataatattaactgaagcttccacatgcgattgcataatttggtattcttcatcacttaatttagaagttttctttaaaatattttctgaaatcccaattttaccaatatcatgaagaagtgcagcttcattaataatctcgactaattcactatcatatccacatccgattgctaattttgtagcataataagcaacattttcagaatgggtaaaagtataatggtcttttgcatcaattgcagctgtcaatgcataaattgtcggcgcatactctaagtaaatattctgtttttctcgatgtgcatcaacaatcgtcacaccacttgtactttcaaccactcctgcattataaactgatacacgatttttaccatgtcgctttgactgatatagcgcttgatctgcataatctaataattgcttaattgtattggcagataccggaatagaactaataccaaagcttgcagtaactacttttaaagtatagtcactatctcgtttattcatattcattatttgctcgcgaatgttttcggccagatcttttgcttctaaaggtccataatttggtaaaataatcccaaattcctttccccctaaacgtgctgtataaccttgtgtatttacataatcatccataattcgtgctacattaattaagacaatatctccttctttattaccatacaattgattataaagccgaacatcatctacacttactaaaatcaatgataattggcgttctcccaatttttcatattcattattcaaagcctcataaaaatatttacgattcaacagtccagttaattcatcactacgtgcttcattataaactgtctcatacatttttgaattaattaaagcaatggcactaattgaagcaactgaagacaagaaactaatttctccataactataccccgagcgccgtggtttgggagccagcaggatcatcccaattaattgctcttgtttaactgggataattccttcaatatttagattttcaaataattgtttctcactgtcccacattgaacgataatttattgaatgtctaaattcactataaaatatcatatcatcgttattcattaatttaatcaccacaggattttcatgattaataatatagttattttttcttaatggtgaactgctgtactcaattgaataatcaccattgtcatctaaaagacaaatatacacttgtttggtttcgacacatttcaaaattatttcacccattgccccgacaatttcatttacttgcaaagtttttgaaacatagttagaaaactcttttaaactatctgattgctgaatttcttcttttataaaaattgcatcaataaatttttttaacattgtataaattatcgcagttacaatcgtaaaagctactgcaattactaatacataataatttttagtaatcaaaccaaaatgttcaaataaaatattttgaaatgtaccaactaaattagcaaataaaataattgacaacattccagctattacataactgctacgtcgtgaaactaaaagattaagcctaaataaacgtcgtttatacaaagtatagaacatacatattgcattaataaccccagcaacaatatcaattggaaaaccagcaaaccaccccaacataacacaagtatttccaaatattaaacatgcaatcccagcaaacattggcattagccggatcacctgattacgattttctttaaagccttttatgatcaacgaaacacaataaataatacttgctagaaagaaacaataaaaaatatacgtataaacattagaagtataataaaatgctggaatcccgctagcccttattgtatattcaggtgctggcagcaagagttctgttgtagcattaataatgaaaagtccgacaaaaagaaagaaccaaatagtatcttttttatggggtgaattaaataaaaattcatggacaaaactaataaacgcatatggtactagacataaacccaataaagaaatatcataccaaaatttgactgatggtccaaacattgaacgcataaagaaagaaccaccagtccaaaacatcatcgccattaacaatgtcataaaagctttaatcaacttagttttctttgaagccgataatgaaataaataaaaatatataacagtacagcgcaataatcgagacatatgtataattattcatatagtcgtcctcccatttcaacccgataatcctgatcttgaatcgttaacagttcattaatttctaaagttggaggattaatttttttaattttatgagaatgatttttttcataataggcaaatgttccagcttttataattgttatttttaacggatcgatacctagaattttctttaaatcctgataatcttgatctacatatttaaaataaatgcttaattgttcccttagtatttcaattgaaatagcttgggtgatttgagcatgtggatccatttcaacatatagatgcagatatggacgattattatgattaaattcttttttagcaatataattagtgattttaagtcccgataatttgacaacttgatcaatcgaattttcagtaatccttgtaaacccgccaatatcaatgacatttggaacccgatcgagatatttaaatcgcggtaatttaatattctcatctttatttttaagatcaatacactgatacatatcacctactcgataacgcataaaggctccgccttttaaaacagatattactaattcataactcattccttcttcaacctcatttatcaatactgttcgaggctgataactagaatcagctagatttttctccatttcgtcacttgggataaactcataaaaacaagcatcagggaaaaagtataatccatttcggctccacgtctcagtgcctatacaagttggttccgttccagcaaatatttccattggacgaataccccacaattcttctaaatcatccttataacaagcattatctgttcctgctaccataaatccctttaatttaaaaatatctttaggttttaactcacgtccttcttttatgcatttgcattttgctaatacaatcttagcaaaacgtaatggtgatttttttaataaagaaatagcaccgccaccgccagaactcatttttcctaaacttaaactaacataataagttacacttcctaaaccaaaaaaatagtcaattccctttgacaatcctaatttaaatcctactttatttcgagttgaaaaactcattttcacagcatccttaacaggcggtaaaaattcaataccgatttcctcttcaaatgctaatggtaacaagcctgttgcataaggtaatggtgctagaccatataaaatcgtatctgtcgaacgggctttaaaatcccctcgctttgttgaagttcccaataacaaacaggcacagacatttcgtttaaatgtatccagcatactttcagtataaggagccaccttgatgggatgtttaccaccctcccaagttgtctggatccataaaaccggttcatctggtaaaagttcgcttttcttttgtaataagtcgctagcataatcatcataagaagttaatggaactagtccacgaaactccttaatattttttggtgtacttccttttaatatttttttccctaatgggcttcgtgaccataaggcaatttgttcttccatcagacgattttgaatctgaacaaattcatccatcgataaatctaaaaagccacagtattcattccaaacatcttctcgactccgtgcttttaatttatcctcaaatttcattttgacacctccccaaatgttctaatacagcttctaatacttttaattgttggaacaagaaatggtactatttttttatattcatcgtaatcaacaaattgcttggggaaaataattatgtcttgtaaaatcacatacccaatatttaatagattaaatccaatcaacataaataacatagtttcattttgaaaagctagatataaacataaatacattaaaatcatcatgtgcacccccggatgacgacataaggcatagacaccggtttttacacacggctgtttattctcagtatttttatatgcatcatcaaattttaacgcaaaaaataacgtatagattaaccctatcgctgccagtaatgcaagtcccaaaaagataataaagtgtgcatctatttttttaggaaaataaataataatattcgctaaagtagcaaatactaatattattgacccaatcgcaaaaaactttttaaaaattttattacctaaataaattaaattcaaatcataaatgtacatcataaaaaaagcaataatcccacaaatatttaacatatataccctctcactctattttcatatatgtctattatacacataatcgctcaattttttaatgtatttagtaatttttttactaaatagtacaaaaaaaggtagacttaacatctaccctttaaaattcttcaattatttattcaattcaatcatcaaatcacaaattttatttgaaaaatcaactggattgtcgattgagaatccttcaatcaataaagcttgatcatataagatacttgcataatcatttactttatcaggattattttcataaacctttttcatagcattgaaaatatcatgattaggattaatttctaaaattctacctgcttttacttcttgaccttcaggcatctgatttaagactttttccatttcaaatgatactccatcactagaaactagacaaacaggatgtgattttaatcgtgaagatacttttacgtcaacgactttatcaccaagagaatctttgattgctgtcaataagtctttattctcttcattagttttttctaattctttcttttcctcttcactatcgatatctaaatcaccttgagctacactcttaaatggtttttccttataatcacgcatcatttggaaacagaattcatctacattatctgttaaatatagaacatcatatcctttgtctttgactacttctacttgtggtaaagtggcaatcttttcacgagtttcaccacttgcaaaataaatctccttttgaccttcaggcatatgttcaatatattccgctaaggtaataagtttttcttctttactagaataatataatagcagatcttgtaatttttcttttaacattccatagctattataaataccaaactttaattgtaaaccaaaactattaaagaattcttcatattttacacgatcttttttcaacattgtttctaattctgattgaattttcttttcaattttatcagcaattacttttaattgacggtcgtgttgtaacatttctcttgaaatatttaatgataagtcttctgaatcaaccaatcctttaacaaagcggaaatgttcaggaactaattcactagctttatccatgatgaagacaccacgtgaatataattgtaaccctttttcatattcatttgaataataattcattggtggttttgaaggaataaataataatgaatcatatgaaacattaccttctactcggctatgaatcactttcaacggatcattaaaatcattaaatttatctttgtagaaatcattatattcttcatcagtaatatcttttttattacgtttccataatggtaccattgaatttaatgtttgattttcaataacatcttcgtattcatcactatcatcttttttctttgaaactgtcatatccatattaattggataatgcacgtaatcagaatattttttaactaaatcacgaatatgatattgatttaaatattcatcatagttatcatcatccgtattatcttttaagtataatttaattgtagttccatgatcagcaacattagtttcaaaaatctcatagccatcactaacttcagatacccaagtatatccttgctcagttccatattttttagaaatcacttctactttttttgccaccatgaaagctgcatagaaaccaacaccaaattgtccgataatatcaatatcatcatgttcattttcatttttaaactcaaatgaaccactattagcaatagttccaagatgtgtttctaattcatctttatccatcccaattccattatctttaatagttaaaacacgattttctttatcgatttcaatcataatttttaaatcattgcgattaattgaagaaatattttctgtaagtgctttataatataatttatcacttgcatcacttgcattagaaatcaattcacgtaagaaaatttctttatgtgtataaatagaattaatcattaaatctaataatctttttgattctgctttaaattgttttttctcagccatactcacatctccattctaaatattagcactcctcattcatttgtgctaaagatattctaatacaactatttagcagtgtcaataggaaagtgctaaattagtcaaaaataaaaagtctctattgagacttttggttaattataaagctgcaacgtttgctgcttgttcaccacgatcagattcaacgatatcgaagcttactttagcaccctcttctaaagatttgaatccactaccttggattgcagaaaagtgaacaaataaatctccacctgtatcttttgtaataaatccaaaacctttttcactattaaaccattttactgtacctgtattcatcagacgtacctcctatttttattataaaaagcattactataaaaaaaagcagatgctaagttgcttataaatacaactttcacatctgtaagttaaatattcattgctcgttactcatatataatatcacagcaacaataagaagtcaaccaatatcagaataatatttcaatttatattttataatctttttaacttaaattattcctaaatcaataaattcataatagactccgtcttcatcaacacttttacaaattcgatcagctatttccttaagctgagcactgccattgtccatgaccactccacatttgactgcatcgatcatttcataatcattcatactatcaccaaatccaattgtgtcttccatatctatatttagataatcaacaattcgtttgattcctgttcctttattatcaagttttgacattatttcaccattaatatttttactgccaaacatatcatgtactacaaagttaaagttctctttcaattctttaaaagcatgatcgaaatcttcctgcttcattgcaataaaggatattttatgaattccacgaccatcgtattcattcatatctcttacattaaatttatcactttgttcagcttttaagcgttccatctccgaattagtcgcttcctcattatttccacctacaaaaaattccatcattttgggtgacatatatgtaatatcggtacactcataattatatacgatattattacgattaaatacatcgcaagctttttcaattaatttacgatcataataacggctatggactacttcatcagcaacttcgatatagcttccagcactagcaataaaaccatcaaaatttacttcctctaactcatttctaattcctatcttatttcttcctgtacaaataaatactttatgtccctgattacgggctagagtgattgctttttttacctgctcagtcattttgccatgattagcaaccaatgttccatcaacatctaaaaaaattgcttttttctccataacattcctccttaagattatttattatataagtatacctattttaaagaatatttgtattctttttacaaaaaaagaaaaagggaagtactaacacttcccgtgatcatgatgataactatctactaaactattagtgcggctatgacaaccagtaccacaactaccacaatttccgccacaactagatttaccattagctttatcttttctgattgaattgattgctaataggactgcaaataataaaatgacactaacgatgatagtcgataaattttcaattagccagttcactgttatcaccctttctatttttcagttacagttttatttaaatcgatatttaaacgattgtcttctttatatggtcgaactaatagataaacaaaaccaatcactactaatatagcaattactgtagcaaatgtaaatgttccagtaataactaaatttccaatttgataaacactaaatgctactaaataagcaaatacagtttgatacacaattgcaaacgctgtccagcgaccattattcatttctcttttaattgctcccatagcagcaaaacatggtgcacataataagttaaagattaagaatgaaaatgctgcaatttgtgtatagcttgctgctaaggttccccagatttctgctccatcgtcagcaacctctgcaaatccatataaaataccgaatgtaccaacaacgttttctttagcaactaaacctgtaatcgcagctactgcagctttccaatcaccccaaccaagtggtgtaaatatccatgcaattgcattaccaattgatgctaaaatactatgatctaactgagtatcttctaacattgtgaattgtccatcgacaaatccaaagtatgaagtaaaccaaactaaaatacttgataataagataatcgttccagcttttttaatgaaagaccatcctctttcccacatacttcttaaaacgttagtaatcgtcggcatatgatacgctggtaactccattacgaatggtgctggttcaccagcaaaacgtcttgttttctttaaaataattccagaagtaataattgcagctattccaataaaatatgcactcggtgctacccaagatgcaccaccaaataatgcacctgcaattaacgcaataattggtaacttagcaccacaaggaataaacgtagttgtaataatcgtcatttttcgatcacgatcattttcaatagtacgtgatgccataattcctggtaccccacatccagttccaatcaacattggaatgaatgatttacctgataatccaaattttctaaaaattctatccataataaatgcaacccgagccatgtatccacatgattcaagcaccgctaagaaaaagaataacactaacatttgtggaacgaaacctaataccgcacctaccccagctacgataccatctaaaattaagccatttaaccaggccgcagttcctaaggattctaataatccttcaattaagcttggaattgatggaactgctagtccaaataaactccatccatcaccaaacacaccttcatttgcccaatcagtcgcccaagtaccaacagtagttactgaaatataataaaccacaaacattactactgcaaagattggtaaggctaaccagcggtttgtaacaatgcggtcaattttatcagaaactgataattgatcatgactatgttttttataacaatcatctataatagaagttataaattgataacgttcattagtaataatactttctgcatcgtcatctaattctttttcactttgatcaataattgtttcaacatcaggtacactactcattaatcctgaaattttatcatcacgttcaaataatttaatcgcataaaaacgtcgttgttccactgcaatatcacttggcaacattgcttcaatctggtctaatttttcttcaacagcactatcaaatttatgaattggtgcatttattcttttagaattagctaaagtaacagcacgatcagccgcttcttttattccttttcctttaagagcagaaatttcaacaacttggcaccccaattcttttgataatttttttacatcaatcttatcattatttttagcaacgatatccatcatattgattgccataataacaggaatccccaactccataatttgtgtagttaaataaagatttctttctaagtttgttccatcaacaatattgataattgcatctggtctttcttgaattagatagttacgtgccactacctcttccaaagtatatggcgacaaagaataaataccaggtagatccattaatttaacatctttatgaccttttaatttaccctcttttttctctactgttacccctggccagtttccaacaaattgattggaaccagtcaaagcattaaatagcgttgttttcccactattaggattccccgctaatgcaattgtaattgacattttttcaccctcctatatattttactactataatacttcaatcattgctgcatcggctttacgcaaagatagttcatatcctcgtactttaacctcaattggatcacctaatggtgcaactttacgaactagtacttctgtccccttagtaattcccatatccatgattcttctttttacagctccatctccatgcagtttcatgactctcgcactagttccgcattttacatctcttagcgttttcaattaattatcccccttttaatagttaaatcataattttattagccatctcttgactaatcgctactcttgattctttaattttagtaattagatttccttggttcttacttacaatagtaactgtcgctcctgttgtaaagcctagcgattcaagaaataattttacttcttgttttcctccgactttttttatggtctgtacttcaccaattgtcgccatagttaaaggcatcatcatcacttcctcgctttttcttgttagtcctatctaactactgttatgttatacctgcctaacttaaaagtcaatagttgccaagaaaaaagttaggatattttaactttatcagcaaaaaaagaaggatttctccttcttagtctaaatcttctccatttgattcaaatgcttttttaacccaatgatatgattttttaggaatacgttttaaatcacgaatatccttattagtacggtttacataaacaaaaccatatcgtttatccatattacacatacttgctagaatatcaattggtccccaagtaatgtaacctagacatttaacgccttcttcaaacattgcatttttcatttcttttatgtgatcacgatgataattaatacgataatcatcttcgattgttttattagctgctaacattgtatcaacttcttcttgcgtcatatcttcacgccatccaattccgttttcaagaacgaaaaccggtaaatcagaacgtgttgctaaatcatttaaagtccatctaaaaccaacaggatcaatttcccaaccccattcattagcttcgcaatgtggatttttaactgtatgttctccaactacttcatgatatggtcttgtataatcaaattcaccttcagtaacagtattagagcgataataactaaaagcaatataatctacagtatactttaataattcatcatcgccttcttcaaatgttggcatccatccacggttttctaaatatgctatcatataatctggatattttcctttagcaaaaacatcacagtggaaaccattcatatattgataagctttccatgcaaataaattgttctttggcgtatttgaatatggataaatattagtaactgcattcataccgcagaattgagcatctggctgtaattctcttaatgctttgacagctttacaatgagcaataaagacattgtgattgacttgatataaatgtttagctgggtccacaccttcaggaatttcttcagcgttagatacacgcaacatcatcccatgtaaattttgttcattaaaagacatccagtgtttaactcgattaccaaatcgttcgatacatacacgagcatatctttcaaaacagtcaacaacatagcgtgatgcaaaaccattatgttcttttactaatttataaggcatatcaaaatgcactaaagttatcataggttctataccagcagcaatcaatttatcaattagatcactgtaaaatttaattccttcttcatttaccggttcatctaaagtcccatcaggaataattcttgaccagcaaattgaaaaacggtaaaaattgaatcccatatctttcattaaagcaatatcttcatcataacgatgatattcatcaattcctactgaccagtcagaaaattctggatcagttggtctaacgtcataaatacaaacgccttttccaccttcgttacgagctccttcagtttgaaaacttgatactgagccaccccaataaaaattatctggtaatttcttttccattacaatacctctctttcatataccattttagttaatctgtaaagataagtaaatgagtttttctgaccttataatcaagtttcatattttatttaataaataccagttttatgaaacaatgtttcatgatatactaaatagaggtgattttatgagtattatgactcaattagaatttgaattagatttctccagttctgaaaaaacaattgcgaaatacatattagataatggtgaagatattcttaatttatcagtaaaagaattagctaaacaaacttatacttctccagcaacaattgttcgtctttgccgtaaattaggacttaatggctatggtgactttaaaatcaaatattcagctgaattacagtttgataaaaaaaacaaaaaacgtgttgacgtcaactttccttttggaaacaccgactcaaatagccaaattgcatatcggattgccaatctgcatcaagaagctattgaagacaccttaaacttagttgattttaagaaccttgacaaaattattaatttactcgatcaagcaagacgcatctatctttttggaaatggtaattctttattagctggttttgattttcaacacaaaatgatgcgaattggtaaaatggtggaaatgcgagctcatgctggtgagcaaggtttcttatcatatacttgtagtcctgatgatgtagccattcttatatcatattccggcgaaacgaatgaaatggtagaacttgcgaaatttttaaaaaagatgcatgttccccttttgggtattacttctatcggggataatcaattatcaaaatattgcacttatattatgaatacaggatcacgagaaaagatattttctaagatagctccttattcatccaaaacatcgatttcttatttgcttgatttgattttttcatgtatctttagattgaattatgatcattatattaatgaaaaaattaatcgtgataaattatttgatcaccgtcatccttataaaagtcccatcaatgattaaaaggctgtttgagcagccttttaaatttcaataatttgtccgtcctctatttttaattgaacatcacatttttgagccaatgatggcgaatgagtaacaattataatacatttattagcttgatgagctaaatcgataaatgtttttaaaatttctttagaattcttttcatcaagattacccgtaggttcatcagctaaaattaaatcaacatctttggcaattgcacgagcaatagcaattctttgttgctgtcctccagaaagtttgcgaatatctcgtaaactttgttcttttgaaagccctaatttttttaaaatatccaggcaatattcttttttattcgggatcttccgtccagctatttcaattgcattagcaacattttcataagcattcatataatgaatcaaattatatgattgaaacacaatcgaaatgtcattccgacgatatttatttaatccaatccctgcagtatcttggcctttaaaaataacttttccaccttttggcttatctaaaccaccagccaatacaatagttgttgtcttcccgctaccgctagcgccaacaattgcatagatttttcctttttcaaaactataattagctttattcaaaatacttacattactagaaccatctaaataatggtatgaaacatcttcaaaattcaaaattgtttccatctctacccctccttcttcacaagaatctcacgtggtgataatcgtaatacataagcagatggaatagcgattgaaacaagacaaattgcaattgtaatccccgctaattgcattactgtagtagttgttaaagacacatctaattctgtattttccggtccattaaatgcttgatcgaacattttatcattaccggatgtcgaattagtgttattgctatcgttattttgatctctgatttccggcatctgcatttgaacttgattattgttcgttccagattctagcatatttccaactacatttgatactaactttccggtacctagtgaaataacaaaggcaacagccgcaatcaaaagcatctcaaataattgttgtaaaataattttcactttactttgtcctaatgataaaaatacaccaatttcataatatctgcttctgattgttaaaattaaaatcaagcatagaatagcacttccggcaccaattacaacgattaaaaacattgttgcaaatgattgagtattttttaaactacttacattttgctgatataaacgatcatttgcatcaagcgtatatgtctcaaaatcgatatcactctttttttgtgctaaggtttgaaaagcttcaatattctcagggtcatctaaataataagttgccgatgtaatatttgtttcactccccgataatgtttgaccaatagataaatctgtataaattgtattaaacggattactttgcccaggtccacccattgttttagcatctgtcacctcgtagattccgacaatagttaattgttgtgttactatttcttcatttatagtagtataaactgtaaatgtatcacctacatttaaatcattatcagtagctaaatttgtttcaatgacacaattatttgttccggcatcatcacttgataataatcgtccctgttttagagtactactttcttctgtgaaactatctaaatattccatcgtcgtatttgcactgattgaaaaatctccttgatttgctgattggaaattttcttgtccatcaggacgttccattgtttgattatcttgacttgtggtcaattcaacagctgtaatatcatcgctacttgctgtggttgaaatagcataattataattttttacatattttaaatcttttaactggtcagccatcgcaattgtaacacttgctgctacttcactaactgcttgccctttttcacgttgacccatcatattttgcatatttgttgtcaatgttacatcattgccaagtgatgttctaatttgctccattgattttttcgaagcactctggattgacaaacctgcaataatcaagttcgcaattactgtcattattacaaataataaaactgtcttgccaatattctttttaatacttagaaatgcattttttaacatatcttaacctcctgaaaaaaatatagcaaactatagttaaggataaaatcgttcaattatgtaaaaaaataggaaactaaagttagtttcccttatctatatttaattgtagaatcttcttgatttcctgatacaactatttcatcatcacctaattgatctttagcattgtcattacttgactgttgcccatgttttggttttttcataaattcacctcaataatattatgtactatttttaatatttaattcaaaatttttaaaaaaatattatcaaatgatacttcttatactagactaatatctaccgcaataagaattattcatttcgactatctttgattctttttatgtaataaaataatcttaatagtttttattcatataatattatttacatttttataaaaaaataagactgttttacagtcttattcatcaccaaagcaaattccaatcgcttttgcagcttttactaattcaccattaggatctacatgtttttgttttccaaatttagcatcaccgattacttcctctaaagatgtataagacatttcttcaccttttaaagtaacaacattaccaaatttaccttctttaatcagctcaagtgcttttacaccaaaacgaattgataaaatacgatcatatgcttggatatctcctccacggatgatatgtcctggattaactgaacgaacttcatggttagcaattgcctgttcaagatcatcagctacctttgcagctaatcctgaataacgaactggatcaggactatcttcaacgatttttccaatcaccttagtcccatcagcatatttagcaccttctgctactgcaattacagtgtatggataaccttcagcgtcgcgttttgcaacgtgcttaacaatgttatcaattgtaaatggaatctcaggaattaagatacatgaggcatttcctgccattcctgaatataacgcaatccatccagcatctcgtcccatcagctcacaacagataactcgatgatgtgattttgccgttgtatttaaccggtcaataaattcagttcctactgaagaagcactgataaatccataagttaaatcagtcgctggcaaatcattatccattgttttagggataccaattacattaacgccttttcttgaaaaatcacgagcacttgttaaagtaccatcaccacctaaaacaaccagcacatcgacaccagctttttttaagttttcgacaccaacatcagaaacgtctttttttacctttccgccatgaccatcatcaacaagatagtcgaataagttatctttattagaactatataaaatagttccaccttctttataaatattctctaccttatcaactgtcaattctatgtaatcattgttataaagaccacgataaccataaacatagccaataacttcatacccgtattcattaatagccgctttggttactgctctaataacagcatttaacccggggcaatctccgcctccagataataatgcgattctttttacgtctgccataaacatccctccataaactttattatatgattttttataataaaactcaataaaaatgttaccgtttacataaaatacgcaatatttataaaattcaacaaaatattataaaaaatattaacttctgccttaaataaacaacatctatttattataaagatgactacattacttttaaagattcaataaataattactcaataattaaattattattataaaaacaaaaatatctactttacgttataatatctttataggaggggtctccatgagaacaaatgaagttgaaaaaatcacaggtttaactaaacatgccatactttattatgaaaaagtgggaatcatccgacccaaaagaacaaataatggttaccgtaactacagccatgacgatttacaaacgttaaaacttgtgaaatttttacgtaatttagatatttcaattgatgatatcaaagcaatcttaaataataaatgcagtttagatgactgtttaaagattcataagcgcaacattgatcaaacaatttctgaattagaagatcttcaaaatacaatatcaacattcaaagatatgcatattccactaattcctgcattagaaaatattaaattagttccagagaaaaaagggcttggatatcgaaaaacaagtaaaacaatagcttataatcgcccactaactagagccatggcaatacgacaggtcatttctgcaggaattattgcttcgatttttacttacggtatttatatttggatttggagcgaaaaatggtattatttagaaaatttatattttgtcgcagtcgtctttttaataaatattttaatttttatttttgctaacttccaatttatgatgcatctttacgataaatcaagaaaccaatctattgaatttttagaagaaggaataagaattttcaagcgtaaaaattcttttcaccattttaaatatgtactttctgccttgattaatcagcattataaatatcaaaagttttatttctaccaagatattgaaaaacttgtcgttcaaactagatagcgttttatccctctttatagtttaggtactggaggcccaagcactgatatgtatgaagtagatatcacactttattttagtgatggtgaaacttattttttattgggacctgaaacatttaataatgacagtcagctgattggacatattttaacagagaaaattcccaatattgtagatcccgacaatatcctaacagcttaccaaaataaaataaatctaaccgattacatgacatcacaaaaaagtatgatttccagataatagaaatcatacttttttattctagtcactcaatattttttatctatgattatttaaatattcttcaatgatccaaaccggcattccaataacagtctctaagtttccttctactttagcgactaatgccttaccttcaccttgaattgcataagctcctgctttacctggccattcgtttaaatcaagataagcgttaatttcttcatcagataattttttaaaagtgactttagttccatcatggtaagtagaaacttttccattatcaatgattgctaccgctgagtaaacagtttgggtctgatcagataacaattttaacatttcataagctgcctgacgttcagcagcttttcccagcatctgattttctaaacataccatagtatctgctccaataacaatatcactagggtattttaaagcaatgggtgctgctttttgataagctaacttctctaaacgtaaaggaagtgccaaactttcatctagcacttcctcaatttcttgaaagtcgattataaaatcaaacttatgtaattctaataattcttttcttctaggtgaactactagcaagaacaagccttttcattattctgcctttggttcttctttaggttcttcttttttaattggtttaggaagtaaagccttgcgtgaaacatttacttttcccttatcatcaactttagtgactttaactttaatgatatcacctaattttatcacttcacccatttttttagttctttcatatgcataatcagagatatgcaaaaaaccatctgttccgtcaaacaaattaataaaagcataattatcttctactcttactactttaccatcataaacttcgccaacttgcgcttttttaacaattttttcaattagctcaactgctttattgattgcagcttgatcataatgataaataacaactgtaccatcttgttcaatgtcgatcttaacaccatcagattgttcaatgatttcattgattgttttacccccctgaccaataaccgctttgatttgatcaggttcaatcttcatcatttgtacttttggtgcatatggtgataattcatcacgtggtgctgcaatcgcatccatcatgtttgccataatttgtttacgagctactttagcttgagctaaagcctcttgtaaaatttctttcgtaataccatcaatcttaatatccatttgtaatgcacaaatacccgcatcagttcctgcaactttaaaatccatatctcctaaatgatcttccattccttggatatctgtcaagatagtatatgcatcccctttttttactagtcccatagctactccagctactggtgccttaattggaacaccggctgccattaaggccattgtcgaagcacagatagaagcctgtgaagaggaaccattagattccaatacttcagaaaccactctaattgtataaggaaaagcttcttcactaggaatcacttgtgctaaagctctttcgcctaaagcgccatgcccaatttcacgacgacctggagcacccattcgtcctgtttctccaactgaatatggcgggaaattataatgatgcataaaacgtttttgatcttctaaccctaatccatctattttttgatgttctccaattgcacctaatgttgcaaccgataaaacttgcgtttcaccacgtgtaaataacgctgacccatgaactcgaggtaacaaatcaatttgcgaatctaatggcctgatttcatcgattttgcgtccatccggtcttattttatcttcagtaattaatcgacgtacttcatctttttctagatcatgtaaaatgattccaacttgtttcatcacatcagcttttatttcttcattttcatattctctattgtcatattcctctgtcacttgagcgattagatcatcaattgctccatatctctctaatttaccgggaattgaaactgctgcagccatttcggctttagcacgtactgcaacttcttcaactaaatcattatttaattcaaacaatggaatttcaattttttcttttccacaagcctcaactactttttcttggaaagcaattaattctttgattttttcatgaccaaacaataatgcttccaacattacctcttcactaacttctttagcatcagcttcaaccatattgatagcatctttggttccagctacctctaaatttattaaagaattctctagctgttctggtgttccgttaacaatgaattcaccatcaaccaaaccaacgttgacccctgcaatagggccattaaaaggtatatcagaaacacataaagccagtgatgcacctaacatagccgccatttctggagttgcatcttgatctacagataaaacggtgttaacactttgcacttcatttctaaacccatctgcaaataatggtctaattggacggtcaatcattcgagctgttaatgtcccatgttcactaggtcgcccttctctttttaaaaatccacctggaatctttccaactgaatataatttttcttcataagttactgtcaatggaaaaaagtcaacattttttggttctttccctgccacaacagttgataaaataactgtatcattatatcttaccaatacagctccattagcctgcttagctaattctcctacttccacacttagatttttaccataaaaatccatactaaacacttgtttattcattctttcacctcatctattatcctagccattataacatataaatttgcatttcaaaacaatttattacttaactactgcaaaagagattaaaaagatgctataatattgattagaggtgattttatgaatgaaaatgaattaaaaagtttagaagtatacaatgaaaagtttaaagaagacccaacttccttcaatgattttcaggccaatgattacattaaactattgaagaaaagcgacaacaatgaagaggcaattgaggttggaaagacatttatgtcattatgtccaaatcttcgcggatatctgaatcaatatgggtatgcactttataataagttcatcaatattgatgatgaaaaaattagagataatgaagatcttttctttagtgtcttaaaagatattttagctgtatgcaaacaggaacgttattctccaatggaaccttcagtaaatcgtgctattaaatatttacaacgtgaaaaacctgaagatcctaacaaattagttgaaatgcttgatttacttgatcctaatctattagatgataaaccatttactaatgatgaaggaaaagaatttgaatctaaaaaagaacgctactatcgattaaaagtaaaagctctatacgaggccaaacgttcaaaagaatgtgttgatactgctaacaatgcactatctctatctttaaaatggcattttaatacattgcaatggattaattatcaaagagcgtgttcattagtcgaactagaacaatacgatgaagctaaaaaagtattcttatctttacataaccgaatccgtaatgttaatttctacgaagttctttataaaactaatgctcaaacaggcaacattaaagaagcaaatgcttatttactatatgaattttttgaaaatggatattcaattaatcatttaggaatttatacacgcttgatggaggctacacaacgtactgaagacccgatgttaattgaaattgtagatgctttcttaacaaaattaactgctgaaaataatcgtgaatatactccagttgctgattatggtgaaaaatataacgatcaaacatcagaagaattatatgatgaattatatgaaaaagtaatgaataatttaggtaaatatgtagaacgtgttgaaggaacagttgttcattataataatcagcgtggtcttgggactatctcgcgttatgatgaagatggtattttctttagacaagccgattatgtttacgatgaagatgttcaacgtcgtgataaagttgaatataccccaattgaaacatttgacaacaagaaaaacgaaattacaaataaagctattttaattattactactgaagaatatctggattttggatattaaataatggttattaggaaacttcctaataaccattatttttgtctatctaaaaattcttgcattgctttaatactctcatttgaaatcacatgttcaattaaacaagcgtctttatcagcaactccttcgtctatgttcaaaacttcaacaaataattgtttaattgtttgatgtttaccacagataaactcagccgtttctttccctttaggcgttagttttacatccgcatacttttcatatataacatagccatctttagccaaaaccacaactgcattattgacacttggtttagatacacctaaatgcttagcgatatcactgactctagctttttttccatctaatgaaagttcataaattaattctaaatagttttgcatcgcaattgacatttcttccatttgttccacctcattaagaataatcatatcataatattacttcatcagcaacttatatgcccatatgcaataggcttttatgcatagtaataattgaggtgaaaaaatggaatatttattatcgttaaatccatttataattgtattaattgtagcaacatttaactggttaatgaccttctttggagcatcgttagttctatttgttcgcaaagccagtcaaaaactcatttgtattgctcttggcagttctgctggaattatggttgctgcttcatttttttcattattacttccagcaaaagaccagcttgaagctggaggtaaacttgatttactaatcattccatttggttttatttgtggtgtagcattattgatgttgattgataaactgctcccccatgaacacatgatgtcacatgaacaagaaggaatcaatccaggtcgcttttcaaaaaacaagctattaatgttagctatgaccttacacaatattcctgaaggtttagcagttggtgtggcatttgcaggatgtcacgatggaaattacttaccagctttaatcttagctctaggaattggtatccaaaattttcctgaaggtactgctatttctttacctatgcatcaatgcggaaaaagccgttttattgccatgatgtatggacaattttctgctattgttgaaatcccagcagcattattaggctttatttttgccactctagtcaatggagttttaccattcgctctttgtttcgcagccggtgccatgttttttgtctgtattgaagaattaattcctgaagctaatgcaactgaaggaattgatttgggaacaataagtttcatgattggttttgtcattatgatgtctttagacattcttttatcataaatactatttaaagtaattaaatttgtttaaatcctaaacaaaaaatacttttttagaaataaagctatttatcctaattttacaagttttattatattgacaaatagaacttcataacgtattattttaggtaacaatctattaaacaaagacagtgaagtgaagtagtaaatatgacttagatatcagagatattgtggttggtgcgaacaatacgttaagaaatattgaattcatcatggagtcggatactgataagtaggtaatcatcggtggctagccgttatcgtagtaaagttttacacttatgaagattattaatgtgagttaataataaacttggggtggtaccgcgactttgtcgtcctctatcgagggcgactttttgtttaataattgaaaatatggagggaataaatatgaaaaaattattaaaggcatctttaactgtaatgatggcactaactctaagtgcctgtgggggaagtaaggatgttaatattggcattgttcaatacgcagaacatcccgcattagataatgctaaaaaaggatttttgaaagcattagaagacaatggctatggtgaggacaatgttgcatttgatgaccaaaatgctcaaggtgatggatcaaattgtacaaccattgctgataaatttgttaacgataacgttgacttgattttcgcaattgctacaccaactgctcaagcagcagcaaacaaaacaacagaaattccaattgttttatcagctgtaacagatcctgctagtgctaaattagtaaaaaccaatgaaaaacctggcggaaatgtaactggtacaagtgatttaacaccggttgctgatcaatttgatttattacaacaattacttcctgatgccaaaacaatcgggatcatgtattgtaatgccgaagataactcaattttccaagctgacattgctaaagaagaatgtgctaaacgtaatttaactgtagttgataaatctgttactgattctaatcaaatacaacaagttactgagtcattaattggaaaagtagatgctatttacattccaactgacaatctcttagccgaaggtatggcaaccgttgctcaagttgctaatgaaaacaatttaccatgtattgttggtgaaagtgggatggttgaaaatgggggattagccacttatggtatcgattattataatctaggatatcgtgctggtcttcaggctgtaaaaattttaaagggcgaagctaaacctgctgatatggcaattgaatatttacctgctgaagaatgtgaattaacaataaatgagaaagttgctaaaaaattaaacattacaattcctgatgatcttaaatctaaagcaaagatggtgaataagtaatgagttttatcttagctattcaaggtgcagcatcacaaggaatcctttggggaattatggctttaggggtctacatcacttttagattattagattttgccgatttaacagttgatggtagttttgccactggcggtgctgtttgtgctgttgctattgtcaatggaataaaccctattcttgctgttttattagctataattgctggatttgttgccggagctattactggtctattacacactaaatgtcaaatacctgcgattttagcaggtatcttgacccaaatcggcctttattcaattaatttacgaatcatgggaaaaagtaatacacctttacttcaaagtgatactatcttcaaaggtttatcaaatactttcaatctatcacaagcatggattactttaatcatcggaataatttgtgcgataatcgttattttaatatgttactggttctttggaaccgaaattggtagtgctatccgtgctacaggaaataatgaacatatggttcgagcacttggtgctaatacaaatacaactaaattattaggtttaatgatttctaatggtttaatagcaatgtctggtgcattagtaacccaatctcaaggttatgccgacattaagatgggaattggagcaattgttattggtttagcttcaatcgttattggagaagtaatactaggaagaaagcctggtttcatgtttactttaactgctattattgttggttcaattttgtatcgtattattgttgcagttgttttacaattgggtctaagtactgatgatttaaaactgttgacagctttattagtaggtatagcattaactgtacctgttatggtaagtaaaagaaaacaaattgctacatacaaaaaattaacaaaggagaaagagaatgcttaaattagaacatgtaagtaaaacttttaaccttggtactgttaatgaaaaaaaggctcttcaagatttgaaccttactgttaatgatggagattttattacaatcatcggtggaaacggggctggtaaaagtacgactttaaatatgattgctggggtttatccaattgactgtggatatattactattgacaatcaagacatctcgctcgccgatgaatataaacgtgccaaatttattggacgtgttttccaagatcctatgatgggaacagcagctaatatggaaattcaagaaaatctggctatggcttttcgtcgtggtaaacgtcgtggtttaagctggggaatcagcaaagaagaaaaaaaacaatatcatgaagcactaaaacgtttagacttaggtttagaaacaaggatgtcaagtaaagttggtttgttatcaggaggacaacgtcaagctttaacattactgatggcaacacttcaaaaacccaaaattcttttacttgatgagcatactgcagcattagatcctcgaaccgctaaaaaagttcttgatttaacagaggaaatcgtcactgaacaaaagctaactgctttaatggtaacacataatatgaaagatgctattaatatcggtaatcgcttaattatgatggacaagggccgtattatttatgatgtcaacggtgaagaaaaagccaaattaacagttgatgatttacttaaaaaattcgaagaagcaagcggtagtgaatttgacaacgatcgcatgctattaggatagagctgattccagctctatttttttattactaataagtggcccttttctggcacacaataaaaaacatcttctattttatctacaccttgttttttcaactctttttttaaccaatttatatcccggttgagcaattttaaattatcttcatcaattatcccatcacagattaaagcatccggtaattctactacacactgatctttaggaataattgaaagtgaaccatttgtttctaataaagcaaattcaactttagaaatactatcaatatcattaactcgtaaatgatgtgataaatcatcaacagtatatcgttgctttttcattatttcttgatccaattttcctttaaaaataatgtatgtaggtcgtccttcaaaaatatcgcgaagtttttttgatttcattgttatcattgaaacaagtcgatctacaacaatcaatgtaacagttgcaaccacaccatgataaaaagtaaaatcgctgtttcctatcgtatctgtcatgatctcggcaataattaaaaatactacaaaatcaaatacatttaattgactaaattcttttttaccaaaaattcttaacaagatacttaaataaatataaatgcaaacactaattaaaaatacatcgaagatattcatatttcaccaatccttaaatataatattagtaagataacaaggaggaaatatgaaatcatatttaaaaatatacctaaaattcgctttatttatccttatcacctttactattactagtcttatcatggccggaattataagttttattcatttatcaaattttatctaccatagtattattaatataattgctggaatcattatgattgtatgggcattttggctaatcaaaatatttcaaaataaagcaattattcacgctttactatgtggattgatctttggaattatcgcattaatggtaaatattgaagacattaatctgattaatatcctttcaagaccaatcattttaattatcactaccttaattttacaattatatacaaaaaaattagacgcttaatatcttggcataatcaatccgtaatgataatgttattatacaggtggcaatctctttaattacctcatacaccaatcatctagttaatcaactttatatacaaatccatagaatatttcatctttccaaagataatttcccttaaagaatgatttaaacagttcttacaaaatactgattaaatcatttttttctatttctacttattaaaattgtctataaaaaagaaccttacttatttttcagtctaaatagtaggttcattttataagttctagtttttaaactcaatgttaacaatttttacatcataaggatctgcaaccccaactgttacaatttcatttactccatgacctaaaacagcttttgctaatggagattcatttgaaatctttccatttaaagggtctgtttcagtatatccaacgatttggtaactttcaggttcagcatctttttctgataaatctaagattgttacagtagtaccgggttttactacttttagatccatttgttcttcagaaataacttcagcattttgaagcatatagtcaatttctttaattcttgattctaaatgtgcttgtttttctctagcagcatcgtagtcagcattttcagataagtcaccttgagaacgtgctaattgtaattcttcaataactttaggtctttcgacattaatcaagttatctctttcttgttctaatttttctaccccactttgggttaacaatactttttcgtgttccataatatcacctcgtagtctctaatatagcataattctatataaatatctagtcctaatatcttcactaatcaactattgaagatatttttgttaacaataaatcaattgctacagtgttgctgcttccttcgggaattataatatgagcatattttttcgatggttcaacaaattgttcgtgcattggtcttactgttgttaaatattgtgtacataccgaatctagactccgccctcgttcttcaagatcgcgtctcaaccgacgaataaagcgaatatctgcatctgtatcaacatatactagaatatcacagcgttctctaattcgtacttcatttaacacaaataacccttcaagaataaaaacatcacgacaatcaactatttctactattttgctacgattatgctgttcaaaatcataagtcggtttttgaatacttttcccttcttttaataaatcaagatgttcaatcaataaatccatatcaaaagctaaggggtgatcatagttagttaagactcttttatccattgataaatgtgtttgatctttataatagtcatctaatttaataattctaattgtatggcgtcctttaaaacagtcataaagctcttgtgcaatagaggtttttcccgaagcactacctcccgcaataccaataataactggctttttcatcaaatcactttccttcccatatcatccttttgtaattcaacactgaccggtatttgtagaatctccattggatgattagctacttcaacttcttcattatcagcatttataatttttgttactggcacaacaacattttcgtgatatgggctaaaaaactcaatttgatcaccaattttaaaatagttacgttgttctattgtagctatttgattaacttgatcatagctgattactcgggcacaaaattcttgtgtaggatgttcatcacgttgattatataactgcttatcgttacccgcctgatcatcaaagaaaccagtgcataaggaacgattagccgctttttgtatttcacgataatatttctcagtcaattcaaaattatcaggatcattacaataatcatcaattaattttcgataggtcgaaacaattgttgcaatataatgcaatgacttcattcgaccctcaattttaaaagaatcgactcctagttcaatcaattcaggaatatgattaattaatgccatatccttacttgacatgctaaaaggaattacaccatcttgattaattttttgattaccttgatatagatcatagtaccagcgacatgattgtgaacatccaccccgattagcatcacgacgtgaaaaataattagacaacatgcaacgacctgaataatgaatacacatggcaccatgaataaaatattcaatatctacatcagttttatctaaaatagttttcaaatcatcgtaacaaacttcccgaccaagcactactcgatccatttttaaatttcgataaaatttaattgcttttgtatttaaagttgataattgtgttgaaacatgaacttctaattttaaattcaactttttagcaattgacataatatatggatcagccacaataatcgctctaacacctgcttgatcaagagcccgcagatattcttcaatcccatcaagattatcttgatgtagaataatattgcatgtcacatgaaccgcagcgccatactgatcagcaaaggttactgcctctttaatatcatcaagtgtaaaatttgaggctccagaacgtaatgaaaattcttttccacccacaaaaactgcatcagcaccatattgaatggcaacctttagcttttctaagttaccagctggtgccaataactcaggtttttttattattaccctttttccgttaattactttacttacatttctcattttcttcccgctttcttacatcatcaatcttataaacagttgcatcaaacataaagctatgatgatattcgatatttggatccagttgataaagttgcgatattaattccttagcgacttttccgtaagttctatttccaacgctgattaaagcatcttgatataaattaacgatttctactaactttaattcatcgacgtataaagattctatgtagaggtaatcaaaatcttgaaaactactcattatgtctaagccacacatttgctgtttactcaaaatatgacatccatattgatcctcataaatatgacaactataatttacaccatttgcctgaatcgtcagatcatctgatattccaattggaatatcctgattgatttccttaaaataattagtcaatagctttctttttgaatatgccatatattcaacaccatgaacttgaatcattgttttaacattaacatttttagcaattatttttttttcttcaagcggtatctcccgtgccaaaaaagcaccattaataccttgagttcccaagtaatttaaagttgcttgattagtatttaatgtatctggatgataaatcatctcaaaatcaaaattatgctcattacaaatctgtaaaacaccaaaatcttgaaataaaattccatcaactccaatgtgactcaatctaattaaatgcttttctaagaaatcgatatatttttcttcaactagtgcatttactaaaacccatacttttttattacctaggaccttttttaaattggcgatttcatcatactcaagcgataatgcttgacgacatgaaaaatactttgccccaacgacaaaatattcaacaccaatatccacataatcataaataaattttttgctatttaaagataatactaacttcattgtgccaccctttttcttatcacacaaataccatcaccaacatgatgatattcaacatcataaagttcgttatcaaagatccaatctttaaaacgctttattttttttaccagttgttttgtatttcgattctttatattatcaatatcaaaaatcataccatgaaaatctaaattatcaacaatacaaataccttcgtctgccactaaaggcatatatttttcaaaaaacttttgatattgtgctttagctgcatcaataaacaaacaatcatattttttaattttcaaatgctctaaatcaaatgataaagcatcaccatgatgaataatgatttgactttttaaattattttcttcaatattttttacagcttctaaatatcgttcctcatttaattcaattgtttcaaccttaaaattattaatattacttaccaacatcattgctgaatatccaatcgcactaccaatctctaaacaacaatgacaattatgatgtttaaaaatttcaatcataaattcaagcccttcacgctgcattacaggtatatttcgggctaaagcatcagcttctattttttcataatatctcattttaataccatttattttcctttactacttgttgatgttcttcatatgtttttgaatagatgactgacccgtctttcaaagcaaagaagaacaaattatcagtcttttgataattcagacatgcctcaataatgtttgttgaaactgtactgattggaccgactggtaacccttcatacttatatgtattatatttagaatcgactgataagtgattatacgttactgctaccgttttaatttgatttgcataatttacagttacatcactttgcagacgcattggtttttccaaacgattcataaagacaccggctatcttagcctgatcttctttttggccagatgactcacattgtacaactgatgctaatgataaaaattgatgcatcgatactttattaccactaatcataaaattactgattttgtctttataagtacttaaattacgatccatttgatccagcatcatctttgtaacatcttcaatcgatgtcttctttgaagtaattacatatgtttctggaccaaaatacccttctaacgggaacataatatcagcacccaaaatactttcatccaaaaaccagtatttttccactaaagtttgcaaatattctttatttgtccatttctctaatacctcggtactatcgatttctaatccctttgctacttgttgagcacattcaggtatacggtatccatctaatatcgtaattttagcagcagatatataatccttatctccttccaaaattgtaagaatcttctttaaatccatatttttatttaaaacataaacattcgctttaaaactataactattaaactttgtatagatactagcaactgttttgctttttaatagacctgccttatcaagctgatttaagaccgaagatgttgatccagatatttcaactactacctcttcacttttagaagaaacagcaccttggccattgaaataaaaaaacactaaagctagtacaacaatcgttattccagcaattgctccaataataattttctgagtttttttcatattctcctccgtcttaaccattatatgatatttttagcgcttattcaacttatctaccgataataaaacatgcttcgtcagtatattatgccaaaaaaagagatgaataatcatctctaataaatagtctcaaattttgtaatgcaaaccggctcactgactagatatgagtatttggtttcaaaaagcattccgcctctttcatcgcggtattcataactttcaactactccacccttttggcaaactgcaacaatccaacgatctttaaagattgcaatatcacgagcatttggtgaagtatcaacaaaatctttataagtcaataaacctgtttcttgatctactaaaaataatgctaaactatcatgaccacgattagtaacaaaaatacgctcctctttttcgctaaaaagcatttgtccagctaagctaggctcatcatattcatcttttggatatgtatcgatggtttgaattaattcaaatttcaaatcattatatttgtaaacacaaattgtattagataattcatttaaaacatacgctattgttccagcctggttgaacataatctttttaggtccagatcctggttctaaatcaaatgaatgttcttcatccaaaataatctcctttgcttccattttaaagagcagtactttatctaatcctaagtcaacaacaattaaacgttttccatccggagtaaaatcgacaaaatgagggtgtggttgattttgacgttttggatcgatactatgtccttccaatttataattaaaaataggtgcaactagttttttcttatcaatttttgccaccatgatctcaccgttataataatcaacagcatataatttatctgctgtttcatgatcaccattagcacaagcatgcatatatgttttacctttatcactaattcgcgatactaatgctaaaatatcagcagttgctgcatatgaacaaattccaccatcaccacttgtacctgttctatttttatatgtaacacacacaaagcgcccataattaaagctatagacagggtctgagggtgttttaaaatgctttttataaagtatttctccattttcaatatctacttgaaatgtataaataccacgtgtctgatcatttccatatgaattgacaaaaaatgattcagtaactcttttttttccaaataatcccattaaagccatttctataccaccttttctagtttaagagaaaaaagctaaataatttagcttttattagttatcgcagttacagtctccatgattaccgcaacattcatgttcttcatcattatcatgacagcatccatttccatggtttccacaacattcatgaccttcttcactttcagccataaaactttggaaaacttcttcaaccatttcccattcttccggtgtttctatagggaataattgtccagcatcatcatagattgatgcaaatacactaggttcttcaactgttgtatcataatacaacacatattgttttcctaattcctcattattaaaagtaaataatacttcaaattctttttcattaccttgatcatcgatcacttggattttatttgcttccatttaaattcctttctattgggcatctaagtagccttgtaaaatcgctactgcagccattttgtcaattacctgcttccgtttctttcgagaaacatcagcaaagataagttgatcttgagctactttagttgtaagtcgctcatcaattaaaacaacattgagacccggtacttctttttctaacatttctttaaacatgattgatatttgtgcacgctcacccaaatcaccattcatatgtttaggtagcccaagtacaaccgttttgatctgatgttcattaattaaagcaacaacgtgctttgcggctctatcataatcatcatctcgaaaacggtaagtctcaattccatgagctaacatgcctaaagtatcactgattgcaataccacaggttcttgaacctaagtccaaccctaatatccgttccatcctacttctccaaatatgatttgactaattcttcaataatttcatcacgttcaatttgctggattatatttcgagcatttttatgacttgaaatataagcaggatcattagagattaaataacctgcaatttgatgtactgcattatagcctctttcatttaatgcatcaattactgttttaagattttgacgaatcatctcacgacgcatatcttcagaactgaatacttttgtctttgttaagtcttgcatattattcgacctcctttaaggctttgcctataaaattattttacaccaattacttagaaattaaaagaaatttttaagttctcccttgatgttggaaatcttatcattaattgggcagccaccttgagcaaaatccggctttccaccaccgcgaccatcaacaactgcattgatttttttaataatatcaccagctttatatccagttgcaacataatttttagtcaccccgacaaagtatgaacatttgtcctcaaattgtgttactaaaattacaattccttcttcaattttatctctaaaatcaaaggcaagttgtttcgctttagcagcatcaatcatttcttctacaaacaacactttaactccattgatttcttgaatatcattggctttacttgctgcatttagcgcatttaattgtccgcttaatatttcaatctcttttttagtgttggaaagttcttcagttaatgcagtaacttttgcaactacttctttacgatttttaagttttaaaatattactaataatatcaaccgtttctttttcttgaactaacgcttgataagcagtctttccagtaaccgcctcaattcgacgcactccactaccaacactctcttcagcctcaattttaaataatccaatatttgcactgtttgaaacatgacatccaccacataattccattgaataatcaccgattgaaacaacccgaaccttatcgccatacttctcatcaaacaacgccatagcaccactattaatggcttcatctttagtcatgtgtgcaatatccacagtaactccatcaaaaatgacattattaacctgattctcaattaatttaagttgttcatttgttattttttcaaaatgagtaaaatcaaatcttaaacgatgatcatcaacataagaaccagcttgattaatatgttttccaataatttcttttaaagctgcttgaagaatatgagtagcactatggttagcaataatcttatttcgcttagctttatcaacatctaaagttaaaatatcaccaactcgaatcgttcctgtcttcaatttaacgaaatgtaaatgctgttgatttggtgcttttagcacattaattacttcaccctgacaattttcattataaacatacccagtatctgcacattgaccacccatctcagcataaaaagttgtcgtatcaaaaatgacttctccataatcatcaattcgatctgttttaacaccatctttaaataatccaataactacactattgatatttgttggatcatattcaaaattcgatggtaaatcaaaggccattaaatcaggtttctgacttgccatactttcactatcagtacgtgctccacgcgatctttcttgttgtactttaagctctgctctaaaagcctcttcatcaacttttaaatctgattcttcagcaatttccaaagtcaattcaaaaggaaaaccataagtatcgtataatttaaaggcatcctttccactaatcacaccatcagtattttttgcaataatactacttaataatttttcaccatttgttaacgtcttatgaaaagcttcttcctctttttttactaagtcactaatataacttactttttctggtagataatcatagaattctttcataatttcgcttacaacatcaactaaatcatacataaacgctttttcgattccaatttgcttaccataacgaacagctcttcttaaaattctcctcaaaacatatccacgacctgcattatcaaataatgctccatcagcaagtgcaaatgttacagtccggatatgatcagcaataactcgataagccatcttattttcttgatatgaaacattggctaatttttctacttcatggataattggtaagaaaaaatcagtatcaaaatttgtttctccgccttggataatactagtaattctttctaatcccatcccagtatcgatatttttttgtggcaactctttataatcttcacgagctactccttcttgtgagttatattgtgaaaatactaaattccaaatttcaatatatcgatcattttctaattcttcataaaacaactttgttcctaaaccatcaggatcatatttttccccacgatcataaaaaatctctgaatcgggtccacatggtccctcgccaatttcccaaaagttacctggtgtttttaacatatgatcaacagcaacacctttgacattaacccaatagtcataagcttcctcatcatgatcatgaactgtaatatataatttatctttttcaaaagcaaaccatttttcatcagttaataattcccacgcaaaatcaattgcatcttttttaaaataatcaccaattgagaagttccctaacatttcaaaaaatgtatgatgacgagctgtttttccaacgttttcaatatcattagtacgaattgacttttgagcatttgtaattcgtggattatctggagttattgttccatcaaaatattttttaattgctgctactccagcattgatccatagtaaagttggatcgtcattaggaattaatgagtggctaggttcaactttatgacctttgctttcaaaaaaatccaaaaacatttttctaacttgatttcctgttaattgtttcatcttgttctcctttacaatataaaaagtcgccctattgctaggaacgactttaatcgcggtaccatcctagttcatgaaaactcatgcccttacttgactggtaacgtagcctacacggtaatctttaattactctccaaagtagctttcctataaaatgataagtattttcaccagccatactttctctgaaagatctattttatagtacttttctttttcaacgatttaccaaattataaactatccaattatatttttcaagactattaatttatatctttacatctttgctttgagttcatacatcatatcttcaacacactcacattcactcaacaaaatcattagtgatgcaactgttaatccaattagtattttgcttcttgtcatcatatatctcacctcagtatagtttacctttattcaagaaaatcatacacatttaaggtttcaattgttttaaaacgactttttaagcttgtttttcgacgactgtcttgataatttgctaaaccatgcataaaagctttagagcttcctaaaataaagagagactgctttgctcttgtaatcgctgtatataatagattacgccgtagcataatataataatcagacaagaccgccataataacgattttaaattcatttccctgcgatttatgaatcgacatacaataagcatgagtaattgtgttaaaagtattacttgtatattcaacaaaattaccatcaaaatcaacaatcagtgtatcttgcaaatattcaaaattatcttttcgacatatttcaacaagcgttccaatatcaccattaaaaacatcatcatcaggtcgattttttaactgcaaaattttgtcacctacacgatattccttgcggccaatttgatatgaatcattaaattcatcaatcggattaaaaacatcttgtaaagcatcattcaaagcatcgattccagccactccctgatacattggtactagtacttgaatatcatttgtgtcataaccttcgtcaattgctttttttactattatcttaacattttttacgacatcatagtttatgcaaggaaaaaagtttatatcccgatattgctcaaaaagatccatattttcaatttcattatgaataatatgatgagccaattgaataattcctgaatccttagcttgtctgaagatttcatctagctcaatcgttttcactccagcttccatcaaatcctgtaatatatttccaggtgcaaccgaaggcaattgatggtaatcaccgataaataatactttattgattcctcgacccgcctcaaaaagtttactcaacaataaacaatcgaccattgaaaactcatcaatgatcaaaacatctaaatctaatggattgcttttattcatagcaaatgtgttactatgaagatcccattttaataggcgatgaatcgtacaagcataaattccagttaattctgtcaatcgttttgcagcccgaccagttggcgcaactaaaccaattcgatcatctgggtacaataccgaatacacttttaaaagtgcttgaacaattgtcgttttcccagttccaggtccgcctgtcaaaatcatgcaagaagactttaaaaaataatttagggcttctttctgcttggcagcataacatataccttgagtcttttcataatttgtcaacaatcgttctacttctttttcatcaaaaagttcatcgggtttatttatccgtatttttaaatattcagctatatttttttcagcctcatccatttcaaaataataatacttatcaccacgttgaataatcaatccttcatcaatcaattcatcaagatattcattaaacgatacttcttcaatattatatattattttagaaaacattattttgatttcatcaaggtaacagtatgtactcccagtattaaacccatattgcttaatactgtaaataatcccagctttaattcgattaggattatcaagtgtcccacctgtttttaaagctaactcatcagctgttttaaatccaatcccatcaatatcctctactagttggtacggattgttttgaagtatttctaatgttttttcttgataatatgcttgaatcaagcccaagtttttcagactgataccatgtcccataaaaaactgcattacttcttgatcataatcaccattagtcaatgcttcataaattatttcccgccgtttttcagtcattcctctaaccaaatctaaattatgtttatcttctttaatcttttcaagacactcttcaccaagtgtatttactatttgtgttgccaaagctttaccaatccccttaaatagcggactagataaatatttaataatttcttcactttcttttgcataaatgatacgatattctgataatttaaactgtttaccatatttaggatgaatttcgtaatcaccaataaaagcatatttttcataatcattaaaattattcatataaccattcattgtgatcaacttatcttcctgctcaacttcaattaaagcaacgatataattagaagattcgctataaaaacgaatcttcttaatataacctgtatattcaatcattataaatacttgattggctgcccatctttatagacagtttcaatcgttccaccaccaagacaaatatcaccatcgtaaaagactgcagcttggcctggagtcaccgcttttattggtttatcaaaagttaagtaaacagtatcttcatcaataaattcaagttgaattggattatctggctgacgatatctaaacttagcgttacatgcaattttatctattggtttagttgaagcaatccagttcacatcagtaatcagagccccggttgaatataaccaatctttttgatctccttgacaaatatataacacatttttatcatagtctttcccaacgacaaaccatgcatcacctggaccaccaatccctaatcctttacgctgaccaatagtatagtacatgattcctgaatgatcaccaatcacgttcccagtttctatatcaaccatttttccagcttgagctggaatataattttgtaaaaactctttaaaatcacgttctccgataaaacaaattccggtactgtcttttttatctgctactggtaagttcaattctctagcgattcgacgaacttctgttttatctatttcacctaaaggaaataatgagttttgtagctgttgttgatttaattgacatagaaagtatgtttgatccttattattatcaaggccttttaacatcaccgaatctgctccttgataatgtttaacttgggcatagtgacctgtagcaatataatctgcatttaaagttttagcaaaatctaaaaaagctttaaatttaatatgcttattacataatatatcggggttaggtgttctaccttttcgatattcatctaaaaagtatgtaaatacatgatcccaatactctttgataaaatccacccttttaataggaatcccaagacattcagctacagccttggcatcattataatcttcttcttgtggacagatatcattatcattagtaggattacctaaaatatcattatttaactggctatcccaattacgcataaacacaccaataacatcatatccttgttcttttaacaaataagcagcaactgctgaatcgacaccaccacttaatcctaatactactctttttgacattctcgtcacctcaccgtactataataccattattcgatttaaaaaactactactttaaatcaaaaaaaaaggatgaaatatcctttcttaacctaatcttgacattggtaacattgctgctccgattgctccacaatcttctaattttgttcctaataacggaatatatccgcgcattcctacatgaatttttgagttaaattgttctactaagcgatcatagaaatattcacgagatttcattacaccaccaccaattacaaaacagtgcggatcaacagtgtgagcaatattagcaaacattgttgctaattctgaaatacattcatcaactatactttgtgcttttaaatcaccttcgctagccaatctaaaaacatctccagcatgatttactctatcttctcctaaaagttctttacctttacgagtaattgcagtaccactagtttctccctcagcagcccctggatttaaacctccgaatttataaccattgtttttaacaataatattcccaatttctccagcatgtcctcgaccaccagaaactaatttaccatcaacaataaaggctcccccaattcctgttgaaatagtcacataataacatgtcggataatcttttccagcacctaataaagcttctgctaatccagcaacatttgcatcgttatcaataaaagttggtaaattaaaacgatctgctaatttatcacaaattggataattttcgaatccaggtaaatttgttgccatgatcattgtaccttttactgtgtcaacaggtccaggtaccccaataccaattccacttacaccttgtaaaccaccacaaattgatgtatctaaactttcaatttgacgaatgattttagcacatacatagtcaggaccattttctctttcagtattatcttttacttcactataagttttaccattttcatccaccagcaaagtacgaacattagtcccacctaaatcaattccaatatagtatttcatatctttcctcctataatctatgtaaataattatacaataaacaactctttatttaaaggtgtctataacaaacttttctctattttttcaaacaaagccggcacagggcaaattatctctttatcttgaagataatttagtacaccaaaggtttttacaaattttattttataagcatgcagcaattgattatttaaaccaaaagtcttcttaatatatttattcagttcaaaatctccatatttacgatcaccaataattgggtgttcaatacttgataaatgtactctgatctggtgcatccgtccagttattaatgtaacctcaacaagactataatcacaattatattttaacggcctaacaatcgtttccatcgttaaagccccaggatagtctttctttactaatttaacttgagcctgattctctaacttgaccatatatccgtgtaaatttcgctgatgactcaattgtccgcgacagatcgttaaatattttttttcaatgcaatgacgttgctttatcatttcattgagattttgcaaagctgccaaagttttaccaaaaattacaattccactagtattcctgtctaaacgatgaactggtcctggcataaaagtattttctcgacttagatctagttcattttttgaagcaagataacttaaaacctgatttgttaaagtattaatgctttcatttgcatcctcatgaactaaaagccctgctggtttaaaaacaatcaatacatgtttatcttcataaagaacactaaacgttttattaacctcatagatacttttggtttctgtaaattctttgaatttatcatcatataaaaacatttcgacctcatcatctaatgataaaatatatttttcatccacttttttcccatttactttgatatctttttttcgaaacattttatatataaaattatttggagcattaactagtaacttttttaaatatttatcaattctttgattagcatcattttctgttatttttaattttttcattatatcaccttgaaacattataacaaaatttgctaaaaacgcctaatacttttattgtaaccctttacattttatgaaactgatgctataattgactttgttaagtgaagtatttcgctttacataccccctattatcacccttacgtgaaataatagaaaaaagtatgcacccccgcatactttttttgttatacttttaatgaggtgaaactaatggaaaagaaaatatcatcagaaataatctatgatggaaaaattatcactgtttataaagacaaagtagaatgtgaaaatgggaatctcgcaactcgagaagtagttcgacaccacggcggagttggcgttcttgctattgttgatgacaaaattttattagtaaagcaatatcggtatcctaatgctgtagatactttagaaattcctgcgggtaaattagaattaaatgaagatactgctatatgcgctttacgagaattagaagaagaaactggctatagtgctaaaaagataagtttaatttctaagtttttaccaactcctggttatagtgatgaatggctttatgtatacgaagctcatgatgtttacaaagtcgaaaatcctttagagtgtgatgaagatgaagtaattgaattaattaaaatggatattgataccgcttatcacaaagtagttaatggcgaaatctttgattctaaaacaatgattgcaattttgcatgcttatattaataaaaacaaatcataatgatttgtttttataaaaaaagtttcaccaaagtgaaactaaacaatctaattggcggtctggacgggactcgaacccgcgacctccgccgtgacagggcggcattctaaccaactgaactaccagaccaatataatggcggagacagagggatttgaaccctcgcgccagtttcccgacctacacccttagcaggggcgcctcttcagcctcttgagtatgtctccgtctattgcttaaacataatatcatatgtaaaaagtttttgcaataattttagccaactttttttctataaaaacttactccacctgataaaaaagcaaattatttcgtttaaatcagtcttatttaaaaaataatttttttattttttttaaaggagcagacccttgctccttttatcacactaaaataacataacaattattccaacactaattcccaaaacaattgcaaaagtaacatcgctcaaataatggacaaacaaatacaatcttgaaaaagccattaatgcagcaaaaatcatgcaaataaagccgactctaggaaaaaagaaacatacagtcgttgcgcatgcaaagcttgaagtagtatgtcctgaaggaaatgaataatcactcggaactggaatcaacatttcaacatcatgatatgtatgacatggtcgcttacgccttacaatcgacttaattgtcacttgaccgatgactgttgctaatattagcgctgccagcattttttgagaaagcagctgtgttttatcattaagacttaaaagtaaaattaaaacaagccaaatcattccaaaatcaccaattccagcaataaacttcatcgcaccactaaaaaaacgatgatgataaaactgcggaaaaaagtgcgatgttttaacatctatttctttaatcttctgcaaaattcgcatcatcttcctccgcttctgtaattaataaataaatcattttaactatatagactattattacattaaaaataatgaacaatactaattttactgccattgtcgataataaaccattacccgcaattaaactagaataatcaggaataaaacttagtagagcatttaagctgttaaaaataaccgcatatatggataaaactagattaacataaaaatcaataatgcttttaattattccagcaacaatacctggtctctgaataaaatcttcaaaaccgataaaaattattaatcctaaaaatgatatcagtcccaccacgataacagtatagacaaaattaataaaataagacaatagtccccgtttttctaataatatttcatcatttgacttttcaaataattctccctcttccaacttagttccagaattaccattaataatatccatcaattcattaacgcgttcaggatcacatcctatcgctgttcttgtttttgaaaattcatcatcctgatataaattctctcttttaaaaacagtatcggcaatttcgttgtcagtttctgaaacttcttctgactctaaaacctcttcaattgacttttccaaagttgcaatactttggggattagaaaaatgttcatcatccactggcactacaataacatcttcatcttcaaataacgatgtattgacggtatcagcttcacgatttgcaatttctcccaaaaaataatgatatgtattgcgaactagttcaatcaactgctgatcattttgatactcttcaagcagcttagcgtatgttttatctagtgtttcaatatccatatcactagacatccctaataacggcgaaaatatttccattgtatcgtaacgtgcaaaaagaaaaatattaataatttctaaattatttcttgcaattttaaatacccttggaccaatcgattcttgtaccaagcataaatcacttagataaattacattgattaaacattgattagctgcataaagaagatttggatagtttgcaattacaattgcctcacttggtttgcagttcatttgttcaagagttgtttttaaaacagcagtatctggtaatggtagattatcgctatcgccgccaataacaaaatcaactttgtcatacaatcttgttaattgtaaatattgaattgcacgttttgttttatgagttgaaaccacagcaattttaatctctttttgtttaaaaaattgtaacagttcatccgttccctctttttttattgtctcaggctttaactttgcatactcgtataaatcacgttcaatcaacttattaatatcatcgggattaatatctttagaaattggaaaatcattatacattgttttcatatttccaagggcttcctcgaaaatatctttagttaattcaaaattgtgagttttacaaatccttttaaaataattaaatctaagccgatttagatctaataatcctccatccaatgataaaataactacttttatattgttaatagtttgtttgtagaacattgccagatcactccattcacctagtaattatagcatagctaatgtcatttttcattaaatttaacttgcttttatgtttaaataggtgtattataatatctgtcctctctccttagctcagttggtagagcaacagactcttaatctgtgggtccacggttcgagaccgtgaggggagaccattaataaatttccgtaattcttatttatataagttttacggtttttttattataaaataaaaaacactatgtcatgcatagtgtttaaaacatcgtcgccattaacaatactgcgattagattttttgcagcatgtaaaatgatcggagctataattgtttgacgtttttcatatacgattgaaaaagataaacctgccatcatatatggaatcaatttaatccattcactcatatcaccagctaaaatatagctgtaaacatgtaacaagccaaataggaatgctgaaatcaaatgagcccaaaccatatttttttgtcgtaaactgttgaaaatcagacctctaaataacaactcttcaataaatggtgcaataattactgattgaaaaaacattaatagaaaattagattgcacaagagtttccactaatgtctggttagctgcttcgcctgattgaggggctacaagattgacaatcagttcccctgcaattgaaaataaatatgctaaaccaatcccgatcgtaagcacccatattatattttccaaaaagtcttttttaaaaacaagccagttttctttaataaaacccttaaacacaataatcaaaggaatagcagttgcaattccaatgaataaattaaaaaatgcatttaaactattagttgaaaaatcattagctatatatactgtatatagcttcaaaaaataattaattacaattggtgcaaaataaagataccagggaaaaatcaatatgacccctatcgccttttgcctactatttaatttaattttttttatcaaattcaaattaacacctcgttaaatattatttttatcttctaaatcaatttcttcaaaaaatactgctaaactagtatttagttcagcaccaaacaaataagtagtcaaagccgccacgataatattcaaaattaatggaatcggtaaaatcatctcaacaacagcagaaagtactaatactaagatagcccatcctaaatatgacaaatacagcataaataaagttcgtttatgtcctttcattaaacgagctgattcactcattgccttggcaccgcgtatattatatttttctaatacaaaaggtgttaaagcaaataccaaactataaataaacgctacaattgcaataatgatgataccaataaaaaagattactcctagtgttcctaatgcttcaattacagttggatcatttaaatatgcacttacattagtagagtatacagcagcttgctcaataattgctcctaattgagaaaaaacattactgtctactgtaaatctagcaattacgaatatgattaatccaagcagcatcataatcaccaataataatatttctctaataaaatatgtgccaaataaatctttaaaacgtcttaatccgactaccccatcttgttcaatagtgacctcatcaccttgttcattgactgtttttaatgcagttaccacattcccatgaccaaagggcaacattataatagttacaatcaatgaaagaaatggtatcaccccgccaatttctgaaccaatataattagccaaagttgttattacactaataaacacaaatactgtaactatattattacgattaactaaaacacttttagcctttaatttaatatcacgaacattcatctttcctctacctccatggggctattatagcaaatatctgactcaaaaggaaactatttaatatccaagcttgtcttaattgcttgattgatcagattcattacttggctatcaatcattccaactttttctttaattcgctgtttatcaatcgttctaatttgttctagtaaaactacactctttttttccaatgaactgcaatcaaccatcacatgggttggtaacggattttttgttaatcgtgaagaaattggcgcaataatcactgttgtcgaatatcgattgcccttattattttgtaaaacaatcacaggtcgatatcctccttgttcactccccactaccggagataaatcagcataataaatttcccctctatgtatcatatctacaactcctttagtgcagtatatgaattagaactttttttattctatgaaaatctttttactaatcggataattatgatatgatatttgcgtggaggtaaaaagatgataacagcagtaatttttgatatggatggtttaatgattgatagtgagagagttacattcgagggatataagcatgtattagctaaacataatttaacattatcattagaagcctataaaactcttttaggaaagcctgttaaagcagtctatgagcttttccataaagattatggcgacgattttgatgttgaggaaacaattaaagcagttcatcaatatatggctgacttatttgaaaatgaaggggttcctttaaaagaaggattaattgagttactaaagtatttaaaagaaaacgactataaaacaattgttgcaaccagttcacagcgtcatcgtgttgatcatattttagaattatctggtttacaaaaatattttgatgattccatttgtggtgacgaagtaacaaaaggaaaacctgatcctgaagtatttttaaaatcatgccaaaaattaggaattacgcccgatgaagctctggttctcgaagattctgaatccggaattaacgctgcctatagtgcaggcattaaagtaatttgtattcctgatttaaaataccctgatcataagtttgcgataatgactaataagatcatggacaatttatcaaatgtccgtgattatttggcgaatgaaaatcattaaataaacaccaagaattaattcttggtgtttattaatttatcgataaacataacaattctttgtgtattatgaccatcttgatatttaaaaaacatatctctaaatgccttaatatcatattttttattaccttgcaaggctgcaataacttgcgtttcattataacagattgctccgggcatgacccttcgataatccacaaaacatcctaatgtttcaatatattcatctaaatccggaacaaaaaaacacattggtttatttaataaggaataatcaaagataattgatgagaaatcagaaatcaagacatcacaaactgcgaataaatcatgagtattttcatgattcatattaatcactctagaatcgtctgatagcgtagttttcaataacaatgggtgaaatttaaagattattacgtattcttctcccagtgcatttaaaactgcttgagcatcaaagtcaactgttttaaaaccctgataaatatttcctctaaaagtcggtgcatataaaataaccttttttccttttagaatcggatatctactatacatacgtgctttcgcttgtgttaaataatatggatcaacaagatgatccgcacgtggcattcctgtaataataacgccctgctcggaaacgttgaaagcttcttgataaggctgcttccaataatcactatttgcaatcacatagtcataatttttaataggatattcacgtttgatagcatttccaaactttttgattgctccagtcgcatgccatacctgaataactttaacgccaggtcgtttaaaattactaattacatagttattgtctgtaatcaaaacaactttagaagtattaattacataaatttgcttaatacagtttaacatatacaaaaaattgttaattaaactttttttattataatttattaataccatttttaaactatatttgttttctttttttaactcctgataaataagttcaagatcactttcaagttgattcgactctaatgaaataaaggctatttgtccttgcttgattgaacatcttaaaacaaatatattggctatttttaagataatattaataataattttctttattcccatctcatcacctactttaataaaatttcaataacccgtttactcgcattgccatcttcatgattattaaactgttcattaaatatttgcaatcgattatagtcaaatttttcagagaaaattttttggatcaattcatcctcactttcaataacatcgcctggtaaatcatgataaatatctaaataaaagcctcttaactcatcacgataagtgtctaaatcatacataaaaaaataaattggtcgttttaatattgcataatcaaaaaatacacttgaataatctgtaactaagacatcggcaattaaatacaagctgctaatatcttctttaggatcaatgtagtagacaaattctttaactgcctctaaatcaaaatcatttacaattaaataatggggtttaaaaataacaatataatctgtacctagaattttttgccactttttaaagtcaacttctaatttaaatgtatacccttttaaattatatgaattgtcacgccaagttggcgcatataaaattatcttcttaccctcaggtaaatttaatttatcttttattttttttatatcatcagaattataatttgataaaatatcatttcgtggatatcccgtttcaatcaagcgctctctctcaatcgcaaaagcactttgaaagacttcagttgtaaaagcactaggactaatcatataattatacttacttacatcattatcgtaggttgaacgcatttcttcaacgctcatttcactacgataaaaggttgttccttctggaacttcaatatcatgtgctaatttttttaatggtgtcccatgccatgtttgtaaataaacttggctatcttttttcaaaacatattttgggagcttgcaattagcaatccaatatttactacgcgctagatagaaaaaataagcaatactaaaatactcaataattctagcattttcaatttttaattttttttgtttatgattttttattgcataaatgcaacgataatcagcatattgtgaatgttttgaaagatattggtgaattgccattggattatcagaataaccgcgaccatgaaaagaaataaaaagaattgttttttcctgacaaggaataaatcgatatacgaatcgatataaaattctgattaacttaccgagtagtttctttaatattttcatttactttcctcccataaaaataaggggtaaaccccttatttaaaaactgcttcaacaactcgcatagcagcattcccatcttcccatgaacaaaaacgttcataaaattgttcataacgttgttgatattcttgattcaaactattcagattcttgattttatcaataacttcttcagtagtataaaccaatggtcctggtaattctgtttccatatcaatataaaaacctcttaatacatcacgatatttatctaaatcatacgtatagaataacatcggcctttttaaattagcatagtcaaaaaacacactagaataatccgtaatacaaatatcactaattaaataaatttctgtaatatcatcatacttactcaaattatacgcaaactcttctagtcccgtaacatctaatgcatcagcaatataatgatgtgttcttaacaatacaacatattcatcaccaagctgctgctttaataaatctaaatctaatttcaatttaaacttatatttaccatttccataatactcatcatcacgccatgtcggagcatacaaaatagtctttttatctagaggaatccctaattttttcttcaattctaaagctattgcatcacggtttggtaacgataataaatcatttcttggatatcctgtttccagcatgttaccatcgtacataaaacaacttttgaaaatatcactagagaatttattcggtgcaatcaaataatcccattcttgtttttgacgataaaattgagctttataggtcggcgaagcagcagtaacctcttcttgatcaaacgctaaacgtttcagtggcgttccgtgccacgtttctaaaaaaacttgttcctcccgctttctaaaccataatggctgacgaatattaaaaacaaaatatttagaaacgcctaaataataagcatattcccttgtgaatcttttgacaatcttaccttcgtaaggcaatttttctttaggatcatttaatacccaaataaacttatatttacctggataattcttcgccaaatattcataaatatatttaggtgaatctgcataactttttcccataaaagtttcaaacataaccgtattttcttcaagcggtttattaatatatttatgacgatataaatatttattcatctcgtttttattttttaagatctttttaaactttatttttgctaaatgccggcttacagtcttctttgctaactcaagatcaccatttagaccagctttgatcatttttttactataacgagaacttttattcaataaacgaggatgaatattttttaatatttctcccattgctttaaatcgttcgttacgccaaatatcatctttactgcgccgaatctttcgtgcaaaaaactttgtgtaatatctaagcattttcgaatctaaataataacgaatataactatctggagctactaaagaagcactatagcgataagccatcaaaaattcatcaaatttattttcagaatcttttatttgtgataaagcaggtgtattgattggatcattatgttttcttttaacaaaaattgcttgttcaacacgatcaaaactctttgcgtaattaactaattggattacaaaaggaacatcagtgtaatagaaaaaatcttcgttaaaacgaatttgatgctcatcaatcagtttcttttttattaaaacatttaagacagaaatattacgaatagcatgtcggctccgaattaaaacatctaccatatattcatcaacattattttggtcatatactttttcaataaatttatcatcataatcatgatctttatcttttaagtttaattcattatttttttcatcacccatggtctcaaaaactttctttttgaaccatgtaaagcgtctaattcctgcaactaaatctaaatcattttgattagcacaagtaattaataattttaaagtatttggcatcaaataatcatcacaatcaataaaatagatatattcaccacttgcctgttctaagccaatatttctttttttagcaacactagaattttctccagcttcaaggatttttaaattaatatcatacgctttgatatcttgatcaatctcttttttattatttacaacaagtaaagtttcataatcatttaaccgctgttcataaacactttctagacaatcatgtaaatactgtttgtaacgatcgtaagggataattatactaagtttcatctttacacctatttatgtagatcgtccttaatttttgttgttgaaataccatcagttcttggtaaatagacaacttcacagtaatcctttaaaaaatcaaatttaccttcccaatcatcacccattacaaatacatctacatcatgttcttgaacatctttaattttttgatcccaagattcctcaaaaataacttcatcaacgtatctaatcgcctctaaaatcaattttcgatcatgatcactatgatatgcctttttccccttctgcgcattaaatgcatcactacttaccgcaacaatcaagtaatcacccagcgcttttgctcttttaataatattcaaatgacctacatgaaataaatcaaatgttccgtatgtaataaccttcttcattattttcacctatccttttatccgatctaaaactttttcccaaaatccaatttgaggattttgaacaattcgttttttaaatttattatctcttattttagccttttctttgttcgttaaactgttatagtaatcaacatattcaccataatgatcacatacttccccgacttcaccatattcttttaacattcctccctcaatccacattgctgtttgacaaaaatttcgaacttgaggcaatgaatgtgaaataaatataatcgttttaccttcatcttttaattcattcattttatttatgcacttttgtgcaaaacctttatcacctaccgataaagcttcatcaacgataataatatctggatttaaatataaagagattgaaaaaccaagtcgtgatttcatcccgctagaatatttttttacaggttgatataaaaaatctcctagctccgcaaattcaataacaccatcaataatctcctgaatctgcttttttgatagtcctaataaagcacctttaacattaatgttttctaaacctgttagctgtttatttaaaccggtattaatagcaaccaatgattgttcaccattaatatgcatgacaccctcatcgatttcgctaattcccgccaagataagtgacagagttgattttcctgagccattagttcctaaaatccctactacttccccttgtgggatttcaaaactaatattttttaaagcataaaatctttttgtttcactacttttagtattaccatcatttttctttttcaatttatatatttttgaaacattttcaaatttaattgcgtaattttccatttctaccacctagatcatatcaataaatttatgtttgaatttatacatcatataacagccaacaacaaacagtattccagtaatcccccagaaagccagcatttgtttccaataatgcataaatccaaggtgatataaaaaacaatctcgatacccacatacaatataatagattggattgattttcatgacaaaacgaataatatcaaacaataacgtctgttcactaaaacgagaaatcggccataaaataggtgttaaatataaaatcaaacgcatacacgctaaaatcaacttacgagtatctcgagcaatcatattaagcacagatgtaatcatcgctaaactcacagcaaaacagcaggccgcaaagcaataatatataattcccaaccactcgattgatggatagacaccttgagtacaataaaaaataatcattaaaagcaatatacaggcatgattaaataattcctttaaaactaccgtagctggtaaaacactaactggaaatttcattttagtaattacacccgtctttgaaaaaatggcattagccccttgagtaatacaaggattaataaaaaaccaaacaaccattcccgccaacatccattgaataaaaggaattccatctacatctttacgattcattactaaaccaaaaacaaaataatatgttaaaatttgaattaatggattagcaaaattccaaaaaatccccaaacgggaatcacgaatatcagataataattcatatttcgaaattgaatatattctaaataaatttgtgaaattctcttttagaacatatttaatactttttagcattttctacctccaaagctacttttatttacaacaatagcattataattatagcacaatgataatgcaattaaaatatctttattttagggggaaaatataaaaaaagaaggtgtttttaccttctatttactcatccagctttcgtcacttggatcttttttccaagcctttaatttttccatatcagcttctttaatatagtcattttcttttgctacaccgatcaatgtatcataatcagtcaatgttacatatttacattcagccgcttcaaaattaattgttgcttttggtaatccatatgtgaaaatagcaatcattccaattacttcgcaaccggcttcttttagcgcttcaacgcattctaatgaactcccccccgttgaaatcaggtcttctaccacaacaactttcatgccgggttctacttttccttcgatccgattgttacgaccatggctttttgccccaccacggacatatcccattggtaattccaaaatatctgccactaatgcagcatgagcaattcccgcagtagctgttcccattaagcattctgcttctggaaaattttcttgaactaatttagctagcccagtttctacatctttacgaacttttggatatgataatgttaaacgattatcacaataaatcggtgatttaattccactagcccatgtaaatggttcatttggtcttaaaaaaaccgcttgaatatctaataaatctttagcaattaattctttcattattcttctcctctacccttgaaaatcttgatatacttttttatatgttgcgtatggatcagcagatccagtaatcgttctacctactacgatataactagatgttaattcgcgtgccatcgccggagtagtaacccgtttttgatcatttacgctatcatcagctaaacgaattcctggcgttactgttatgaattccattcctaaattatcatgaatcactttagattctaatggtgaacaaacaacaccatcaagtcctgcttctttagcattagtagcccactttaaaacgacattttctaatgtatcgttaattaaaagctcgttatctagcacttcttgatcaagtgacgttaaacatgtaacggcgatacataaaggtcgtttatcacctgtcttgcctgcttctaatccttcaattgcagctttcatcattgcgatacttcctgaagcatgaacattgaccatatctacttctaattttgctagttgcttcattgcactttttacagtattaggaatatcatgtaattttaaatctaaaaaaatgttatgtcccatttctttaatcattttgatgatttcaataccttcaccataaaatagttccattccaacttttacatatagtttttcatcattgaatttttccaaaaattcttttacttctgccttattttgaaaatccaaggcaatacaaattctactatctgtcatacatacctccacattaatttgattatatcaaattatcaaaattaatacattattaaattaattttttatgcaaatacttttttcaattttatatgattttttcttagggttatccggaatatcattttaattattttaatttaaaccaataaaaaataattttcttaccattttataaataattataattgctatcaacctgtgcgctcgttctttaaacaggatggcaaaactgtcgttttaaaccagcaattaataatctaacgaagaatcaaattcaaaaaaaagtatatcctaacttctgcatagttaagatataccagtttaatcccgtagggattatcccatacggttatataccgtcctctataatgtgcattttagagccatttttttatttatgtttaatttttagcagaaatttagcagttgatatttatatttaaatactagactttaaaaaagtatttgtattttttctaaataatgtattgtcctttgacatatccatataacctcctttagtatcttagtgtacaaaacacttttattcaacacaatcttgagtattcattgctttttttattataatactaatgaggtgttaaatatgaatttaaaggacagaaaactgcaagaagcaaaaacaaaattaaaggtactggaagaaaaactgaaacttttagaaatatctgacataccaaataaagatgaaatgatcattaattgcaagcatgatattgaaaaacaaaaaagaattataagccataccacaagttatctagaataaatatgtaagttactaatagctacaatgcttaaaggagcgctctaatcgaacactcctttatcactataactctctatttttttgattaatcttccacttcgattgcttctacagggcaagattcagcagcttctttagctgaatcgacatcatcaccaataacagatgataacccttcatcattcatttcaaaaacatctggtgcaacacctacacaagttccacacccaatacaagattcatttactgtaattttagccattgtaaatcctcctttatgtgtttactatataataaataactatattttacaatatgtttttccatactaaaaagtattacttattcaatcaaatattgagtattaagtatatgagttgataaaaaatgacaaataactataattgatattgtacaattattgatccccactataattccaatagttgtataatagggtatggtcctcctttccccttagccatacccaaccaagagcacaaaaaagatatctcctcgatagagccttgtgctcttttatttaaaagtttaatacatttgcatattttgtataatgtagtagaatagattgcgtacaaatattatttttgtacaatagaatattgttcctctcccattaacaatattcgaaagtatacaaagagtacaagttcacctctcccgttttgggcttgttctcttttttgttagctaaaaaaaacaatattgtgcaacataataaattaatatatactaagattatagtatggtaattgtaaataccatgcttccagcataattaaaattatgctaaagaaaacacagcgttccattcccatgtcgctgtgtttttctttttacaataaaagatgtacaccatctatatatattataccttttagagtgtatttaatttataaaaattatgattaaaataattattagtgagcataacatatatgtgtaattattaatacatcacacattttattatagatcctttgttaaaattccactgtatattaaaaagctgatttattaatcagttttttaattaattctaataaaatatatttaaattttgtactgtacactaatataactgcatatatattaatgtataatttcttaattgtacagcaaaattaattttgcgtcatctttatactcatctttaaagattgttaaatttgttttgccatctgtaaacaaaaaagccagataataaaaaatctggcttttttgcatatctaaattttactgtacgaaattaattcatttttaatatcgtctattgactccctgatcattctcaattccttaattactttatcaagatccttcccttcactttctagaatttttttagcgcggttgagcatttctgctagttcatctagcctttccatactaaatctccccttcttataaattatagcatatgatgtatattgctgtatgctataaatttatagactataaaggactcaaagaattaaaagattagatttttaatttatttcataacaaaaagaacacctttcaaagtgttcttacatgactaaaacttatctaaattaaaacttggtggtacatcatttggattaaaattttgaccatccaaatctgataaatcaaaatatattaaggaatcccttgtgactccccaatctttttgtgattcagcagaatcttgaatcttattaaatgcctgacgaaacattgtattatgagcttcttcacgatttaataagaaatcaattgtttccctaacaccactgtcatctatttgacgatataaattttgataaacaacctttgcacgctgttcagatgctatattagacaaaatatcagcggcaagatcgcctgtttcattaacatatgctgcagtccacaaataaccagatgcatttgccagcatcggggttaatcctgttaatacatgtgcctcaacacttccaatatctgcctcgttagcatttggattctctccatttaataaatttatcaattgtgcaatcatttctaaatgagataactcttccgttgcaatatccaagaataaatctctgatttctttatccttaatacgaaaactttgagcgaaatattgcatcgccgcctttaattctccctgtggtccacccaactgttcctgtaaaagagctgcataattagggttgggacgatctacttttactggacataaataccgactttcatatttaaacattactttcacctcaaaataagtattgtccatattttttatttctatacgggaaaaccattttaatgttttatttatcataaatactttattttacttagtctaattttcatttatttttccctatctattaaaataattatctttttattccaaaatcgttccacaatttttttatttgtaatcaaaaacactttacatacgtatatacgtatgttataataatattgtaaagaaaggaggtaattaagttgtggataagaacaatttaaaagacttactcgatattgtatataagctaattcaacttgcaatcgctttagcaacatataatatctaccgtaagtctcacaaggggaagtaattccccttacctataatatattataccataacttaaaacaatatctatgaaaagtgaaaaaattttaaatctcttgatcggtcttattctaatagattctatacctgatttgcttgaattcaacaactcacttttaggaatcgtaaaattaatcattaatatattgacagttttaatttgtctttatattttaaaagaggtaaacaagaatgaatgaacggccacaggaaaaatacgacaaaaaaaatatggcttttgtaaatgccaaatacaaaaaagaatttgtacaggaattcaagtcggcttgtaaatctctaggaatctcgcaaagtgaagtatttcgcgaagcaatgatcgaaacaattgaaaaagcaaaaaaacctaactcaaaaaaatgagttaggtttgatttttaaatatttattattgatatatatttttttaccatatccagaagtgattatactatgagatagccccttatgtataagggtgtattctattcgggtatttaatttgctaccatgaacatcttcagcaccgtgttttagataaactttattcataagcataaacacccatctgattttggagttcttcagatagctcgtagtatttctggtattgagatttataataatctctatcgccttgagtatcctgtaattctcgatttgttaactccagcttaatttttagattacgggatacttgtttttcttgtaccagggcaattcctaatagtaatgataacagcactagaatggctaaaattgatacttctatgtgtttcatattgctataccttttttaaatattgcatagaaacccatccgcttggacattttccccaaccattttgaattttagagatagttacacgtgtaccacgatccaaagcgccatccttgtctttatcgtgatttttaccatcagcggttaatttgttatgaccaactggttttccgtttggggcatcacgcacaattaaatcagaggcagttacttcataagtacctaaagtgtttgatgtgttattagaacttactttttcagtatattctaatttaacccaacaagcgccagtatatccccaaccattttgttcttttgaaatgtttaagactgttcctttagcataagcagtaactttgcttcctgaagtgcttggagtagaacgaccgttcaatcctgagtttgcagtaactttaaccttataattaactgaagatccgctagaaactctttcagtatattcagccgaaatccatccttgactgatatgtaaccatccattagattctctatctacagcaactacagttcctttagctaatgcagttactttagaagcactagcagaagcagcagaacgaacatttaatccactatttgcagtaattcgtacttgataatttactgatgttccattatctggtgttggttgtggtaatggttgagcatttccgtcaagattagcttgtaccatgtttaaaaatctttgccaccccatatctagtgttctatgtgggcaatatttatcagcaaaatcttggtgttttttaactttatcaataccccagccatgtgcttttaaaccatctgcaataagtttagcggcattttgttcagctttattaaatctatcgccaccagatttagaatagcaaatttcaacatgaataccatataaatttccttgtcctcttttaccatcaccagaagcaaaagcacttctattctcaggtaaaccttgaatggcttctacatcatcaacagcccaatgaaatgatactttgttattgttcccaatcatatatgaaacttcattttttgctggagcatcattatatgtgttgtgtacaacgtaaaattgtggtgttctttcataaggacacttaatatcatatttgcttgagcttactaaattttgtttgatttccattttgtttttcctcctgaatttaatttaaaagagcggaatcactccgctccgttttctactctcaatggaagctgctgcactttgttatataatctttctgctgttccattacctcctaaagccctgtagggattataaaggtagtccagttcctttagatcatcagcagtaacataaccgattatcagcaaccgctcacaaaaacgaacgatacgttcatgtaacattgcacatagcgcctcttccataacaatttgtcttttagtctggtctaatttctcctgctctcttttttcttcgagtttttttcgacttttcttactgtctctggaattagttacaagataaccaactgcagcagttaagacaatagaccatgtactcattaaaaattcttgcatcaggatctgttactcctcttttttattttcgataattcgagtaaaagcctgatgcaatccggtactagctaaaccgcatactgcaccggctacaactgtttctactgttacatttccggatacgatgcagtttaatgcagcaccctcgaaaaacacaactgtaggaatccatttattatcaacatcttttatccattttttaacaacatatccagttgctagacatccggccattacgaccggaacaaaataatttgaaataaaacctaaatccatattttaccttctttccagacgatttttatgccatcctgaggcaatataaaaagacacatacttctgtgtcctaataaccaattactcttaaaatatgttcttctactgcgtcaactgcattaccgttaataacctgagtacggccagaaagtgatacattttttccactaaaagccaactgacaccgataaacagtagtaacaccatttatagcctgtgcacgttccaaatgcatcttactgtctttagatggaatcattgtatccgaacactgccccaaagtagaatgcggacgccagataacttctatatagtcatagttcgtatagtaatctttcaaagtaaaattagctgttgtgtcgccgtcgaaaagaatagttcccaacagaatttttttaccgttcatatctttaagtttacccatatttcctcctgttttttaaatcatccaacactctcatcatagtataccgctaatccaagtgtttctttatgatcattaagcacatcgataagtttattaatatactgtattgtagtcttaatctcactccatacctcccgaatatcggcaggatcgctcatatcgatatccggcggtactgtaatttttgcagggatattaaccgccaatcagatcaccccacttctttaaatcgtaaaggtttttccagctgtagttttttccaacaaaatcccacgttcctatagaaacacgtataataaactgctctttaactgccaaagtggattttgtcagttcaacatcaagaattttataactcatttatcttacctccactttaaacatttctttcagcgtttcatcagcaataaaatatgtcacgataagatcgtagcggccgggctcgtctatacttagcataaattcaatatcgtgttcatctatttcgcagtcaatctgctttatattctcaccatactgcataagttcaacgtatgctctgttaatagaaaaattctgttctttcctgctgtgcaccgaaaaaaccgttttaagattttcacctgcaatcagctttaattcttcactgcacacggcattacctcccttatcatacatttatagtcatttttaaaccttactgttacatcgtagtcaataattttaatatgccagcataaatttgtagtatccacttcaaataatgctttagacatatatcctacatttccggctttatcgtatgcatacagatcaatatagtattcaccggataaattaggaggcagttccgcctcccatctttgtccttcagtgaaatagaaaataatctcaaagtttggattttttcctattaccttttcaaccattagtctgttacttctactgcaacgacatacgtcttgccgccatcgaccggattcggtgtaatcgtaacgtttgtaattaccggtgcttttgtatccagatttaaagtacgtgtaattgttgtatcgacaccgctggcacttgtagctacaaatgtaacggtattagcaccctcaactaaagtaacgtttcctgtaaacgtaccgtcactgattggtacattctgagcatttccattccctactttgacagttaatctagctccgtttgttgaaccggcaaaagctacagatgcatttttatgccaagaaccgtcttccggactggtaatagacaagttaggtgcagttgccagtaccctgaatgtcaacgttacaggtgtcgcagcatttccatcattgtcgctcgcatttaccgtaacagtgtgttcaccatcttttaatgcagttgcaggagtataagtatatctaaaccctccctcgatagcggacttgctcaatccgcttactgcactattatcaatttttaatgtaacagtagattcattaacacctgaatcattgtctttaacttcaaaactgatttccggtttgttttgagacataagctgaccgcttgttggctttaagattgtgattgtcggtgctactttttctttaactactaaccgcagtttagaaccaagtgtttcatgcttatcatctacagtcactgcattgccggctttgtctgttgcctttatctgtacgggataataatgtccttctttaggataactggaagttgccggggctgttaatgttgcctcgtattttccggtctggttgtttaaagtcaatgtagtcgtaaccccgttgataattgcctgtactgtttgtattgccatttatttgctcctttctttattcttcataaaaaaccaacttagataaatcaattgatgtatcaccagtttttatctcagttggcagtgttatattcttatcttttaaatttaaagtatcttcaagattatcagaaccaaaaatgtgatcatcaacatatttttttgatgcaaaatcacctgacagatcatgatacggaccccacgaaccatcagcaagttgaaatcttatctgtgtcccgttccattcataatttcccatatagcttattgctgtattgatccgctcctgaaggtcggcagttgcactgtttaatttccttgcattttcaagaatctcattaatttcattttcaaaacgggattcaaacagatttgtaactaaatttgaaaccagtgtttcccatgtaccatcatcgggaagtttaattcctgactctggtgcatttgcaacattaaagttaataggaaatgtttttattttggtagtatcttttatatatgcaaatgcgatttttatttttcctccacgtttgaatgcattagccggaattgtaaatgaattattctgaagttccctaactgtagaaatcagtactccgttttcaaaccatcctacatacggtaccaccgcataaccggaataatcctcctgattttccagttcgataacaaccggaatattggcactcccctgagcaggaataacatcagtgccacatgacagattcaaaccgtcaattttaatttttatcattaaatttttcctccagtctttttattctgttctccagtttctgtactttttgaataccggccatcgaaagggcattataatcaacgctgtaaataccttcatggtttttatccagaatatacatgcttaaaggatgatctataatatcctgtgcaacaatacctatcgcattttcttttccatttttataatcaaatgtttttatttttaaaatatcaactaattcagagagatcgatatcctctatattcttttttaattttttgtctgaacctactgtaataggaaccgatgatgagatcgttgaaccgctgatatatatatgattggatgccagaagctgaacattaggaccgtctacagatgttgtaggcggattcgaatttaaaaatctaagaactgtattagttcccataacagcagcaaaatcgccgttcccagaaaaacggatatttcttcctatcgtaatatccttatctgtagctatattgctcccatttatttctccaccttcaatcgtcgaaccttttaccgtacctgaaaattcggcatcagttgctttcatatatcttgttacaagctcacctttatccatatcccaatagctgttgccctgcctgtcgcttagaataccggtaattatgtagtcagcaactatactttcaaagtttatagcagttccccacttccagtctgtatcagtctcgtttcgcttttttgcaatttgaatgccctgagtaccaatacacagcgccccgaaagtcggactgtctttatctatgtcctcaaacagaattgctcttacatcctgctttttggcaatatctttctgtgctttcagcgatgtggtcagaagatttatcacaccgcttattttttctgccattagggtattgttcgatttatcgataactttatctactctgttcataacagaatccatatcactaaaataactgcttatataatctcctaaagtcaaagtatctactttttttgtgatcatatcatatgtcatagaaataactctggcctcagttgttatgttaagtcttctgtgtccgatatgtgcagtatcaccaagatttacatttaaaagtttcttataatccttatacatatctgttttagataaatcgaccatatcgacatcataggtaatcgaaggtacgtcaataccgttttcaaactcgtctgctgccctgtttctcagcgctgtatataaatcctctagagactcgcatacagtgattccattttctaaatcaccctcctgtgcatcctccttgagctttatatcctgatattcaattactctggtatataccacaggatatttgtttatatttggactgtcgaccgtttcattatccggaagtatataaccgttataactttttggtatgatacgtgttgccacttcggtcatatcgacagtttcagagattcccattaaattaaatccaaattctacacgaagtccattgtcagcaccaagatgctcattaactgtaacagtaaaattatcataagaaatttccccgccccaccggctggtgaagctgttttcatcatcgccgtttagtgcctccataaagtttttttggatataataactggtattcacagccttgatatctgatgatgctgagtatttttcattagatgctagcataatatcaagtgcttcctgaccgtttttttcagtaggtcttacatcaaaaagaaaacagtcatttttagaatcgaaaaatatcggatatgcagtacatgtcacactgctgtcattttttgttatattccggatcctgaatagctgttttttccctactggtgtttcactgcatatgaccgcattttcagtcagatattcaagtttatcatccaccgggtgagtcatagaaacactccacgcaccgtttaaattcatagttaacatgcattctgtcggattcagtgtcatgtcgccattcatgctgtattctgtattttcaggtttgtatatttctatcattatctgcacctccagttgggaattatcataagttcaaatccatctgttatggatatttcattcatgccctcttttaactgcatatcttcataatctccactgacagctgtattttgaagcgtaccgtcactgcggtagcttattttaagaaatgtatcaattacaagattctgaccaatattgcatttaatgtcagtaccgtttatttccagatggcagactccttcacctgtaataaaataaagcggtctggttctttcataaccgttatacaggacttttttatatggatatttatattttcctgaaaccgaataataatacggatcaagagtgacacctacagaaaactttccaattctttttgatactctttcattagtatttataactgctttttttacacgatgataaaactcgttatcgtcactgaattcaagagtttttgcatctagaaacatttttttacacttcctgaatgtgtcatgccactgatcgggcgcacacatatagttgaacgtaagtgtaatctcaatatcatcatatgtccccagatcctcatacagtttcccgtcacgaccgggaatatcatattcattgtaatttttaacaggtgcagggatatccggtcttgttgtcggcagtatcttctgctcaatacagcttatatcattaatataaatatcgtacacagtactaatacccccttaccagtctcatacttttttgatttgctgaaatttctttttcaacatatttagtaatatccctgccgttaaggtctgctcttacgtttactataacggtactttcatttacgttttttgcacttgattcgattgccggattatatgcaagattcatgttcgatgctaaggaagctatctcatcttcaacacgccatctgttatccttgattcctttagacagaccagacatcatatccggcatccattcttcatattctctcaacggtcctttatccgggcgtgaaaaatgaagccagctgaagacagtatctgcaacatcagaaaccgcatcgaccacttttccaatggtaccggttatcccgtcaacaaatccgtcaatcatatccgatccccactcgattgcttttccgggaagacctgtaaagaaagatgcgattgcatcgattgtgtcgctgaccgcagtgcttaccttgttatacatctcactgccccagctcgcaaatccatcgattgaatcagaaagccattgagatattccatcgaacatgttatgaaaaaatgaaccgatatcatctacatagtcgctgattgctgccccaaaatttgcgaactgatcctgaaaccactttacgatttcatcccagtttttaaatataagaatcaccgcagctacaacagcaactactgccaggatcgtcgcaattacaggtaacagtgacatgttaagaagaccaaatccgacagctgaacccgatgcggcagtacctgccgctgctgctccgcctgccgctacccctgccgatgccccgaaaattgaaaacagagaagataccgccattattgcaggagagaggattgtcagaattgttataattcccaaaatcactcctataacagcctgaacaggcgcgggcagtgaattaaaaatttcaataagttcagttatagcttctgtaatagaagtaaatacaggcatcagagtttcgctcaaatcactcaatgcttcctgatactctgcctgtgcctcattattttcaatcagagctttattgttgtcccgatatgcttctgcagaagctatcagcccctggtcagccagttcctgaagtatcatattggcgcgttttgactggtcagtcgttgcctggagtttagtattaaaatcatcttcactcgtacctgcccagtttaatacatcagcaaaagtaccggtaacagtacctgtcttgactgtttcattaactgcttctgctaacccgtcaataggtatactgtcaccatattttgtccatgctccaattgttccgtaagtcagtctggtcagttcttcctgacttaatcccaatgcctgcaggtttgctgtagttgtggcagctgtctgatcatctgccagtactccgtacaggattttatatgtttcagcagtttgttcagctgtgtatcctgcaagctgtgaggatgcttcaagagcactcattatttttaaatgttcttttgattcatcaacaatgcctctgatattttcagcaattgccgaagcagcatcagaaagctcgctagttgcaaatgcgcctttgatggtatcgcctagattttttgtatcattttcagcgtttttcgcctcatcgcctaattttgacaatccggtagctgcatcacggcttccttctgccatttcatccagatacgaattgttggtccttatttcatttgacagtttatttgaaaaggcggtagtctcatttatagaagtactcagcttggaaatatttgcctctgtattcctgtaggcactctgtgccttgttcacttcttttgagttttcgccatactgagcagtaagattttttatttctgcttcctgttcgctcaataaacttttctgcttttcaagctgcccttgaaacagttttaatttctgctgctgtgtctcatactgtttttccagcactttatttttagcaataagggcttcctgactgttagcattatcatcaaactgcgaagatacagcttttaattcgctgccgtattccttaagtgaattgttgattttaatcagctgctgattaaattccttttcgcctttcagcgttattcttggaccgatatcatatgccatgctctcacctcagttctatcggaatataatagtcattttcaaacggtatatcttcatcgcacagcccgtttaatatatcggctgcatcgatcaggtcgcttaattcaccaataggcatatataaaaattcactgctcgggatatgcatcatataggccttggcctttaaataaatatgtgtatctcccgtcagcttctttgcttctttttttttgaatgaccgctgatttcaaatggtttagtaccgatttttttaacgtttccacttctgatacatttttgaattttatcggtcagtcctttgattgaattttcatccagaggcaggctgacttttacctgttcactggttaaataaaaaaatctgccctgtgtatacggagcatctttatacgggtcaagatgatatgcattgcagtatcgaacccccgagtatatcatcattgcaatgatgtcactcagcatatttaactttttatcaactggataatttctatcctttaaatttctctctaatacatttaaatcgcggtattttttagcaatctgttcagcagtaacaagggaaaaagaaagagggtatttgataccctctatatagatgtattccagattcattaatgatcacctgctaaatcgctagtagttttcccgcccttgaacattaagtattccagtgcatcggccttagtttccagatctgctgtaaactgccacggattgatattatcttcactgatctgtgctgatcttaaaatctttcctgacagttcctgagtttgccattctactgtctcaccttttgttgttgctgcattgcttggaatattgaacagcactcttgctaaaaataccgcacgatagaatgtttttccgtctacctgatgcatttcaataacgcctacaccaagctcagctgactgcatatcactgtcataagttaattcagttacactcttaccgttcggtaattctattttcttttcttttacgtttaaaataagttttgacgtatcatttgacaaatcaccggttgtaacattaaatgttccgcttgaaaaagctgcactgtcgctttcagcaatatcatcatctaaatacagatcattagaatcgccggcttctatctctgttgaatattctgctagtttttcactgataacaggatcactgtaagtaacattgtttccatctgccttatactttgcgaaaactaattttgatagtcctttttttgccattattccatctcctttttaatttcctcttcaattacattattcatcgtctcaactgttttttcttttgctttgcttatcgctcttcttacaaaatcattcttatgtctgaatgatgttcctgatatgatggcacgggcagtaagcacgacagggacaccgccgggataatttctggttttatgaccgtagccgtcgaaaccgatttttacatcaatactgtctgcgattttctgcactggtgaaatcccaaacccttttatcagatcatccttttcttccggcagtactccaatctttttacgtttatctttttttccctgaatggctatcccgcttgcaggcagcgattcgatttctttttttatttcatcagctgctgttcctgcacctttataaactgctttttttgcaatcccatctgaattctttaccagtctgtcaagaacgcttacaaactcttctgcagcttcgatttccatttttcccattatatttcaaatctccattcatagtgaatgaactcagtttcctcttcatactgaactgaattgagtataaaggatatatcagccccgctgagtgcattctgtatatcatcaatcagctgatcatattcgtcttttgtaaacagatcaacagttcccgttatgacctgttcattctttttgtcattaagatgaagtgaatcgccttcaccatcctccatccagactatatatggaccgtttttattctccgcttcataatgaaatacattttctgtgacctgcgtcaaggcgtctctaacggttttaagtttcgaaacaacagacatttttattcatcctttccagactcagttttgtacagtctattccgtcgctgtctttaaaatgctgagccagtacaattttaaattctgaatcatcttcaaatcttgcaatatcatttactcttatacttctgtcctgatatatatttacaactgtttctattttttcgttatttgcaagggcggtataatatcttgtcagtcccagtgtctcataactaaaataaaaggaagatttatagaacattttatatttaggcttgtcgcctttttcagaaacgtttaccagtctataaatctttattattccatcgtcaaatgtcatttttgtttttgcgaaaacaggatattattaagctcataacgcagatgccggggcatcttcatttcgctgttcgctctttttctgaaaaggaaggctgcatagtcaacaacggccatatcgtaatcatttgtaccgtcattaactattccttcacgtttcattaacgattcagcctgtttcagcagttcctttaggtacagatcctgtgaatcagtcaggagctgtaaattatttttcaggaccgataatttatggctgtcattcatttttatttagctttagccgctaaagtttcaacagtattagcgctgtcaggagcaaatgcagccacagtagtaggcgcttttcctgcgatattcataattgaaaatgattcagcaattaccggtttaccatcgtatcgtgcagttcctttaaatgctgtctggtcttcaaagaataatacatcagttgaagttgccagctgcataccgcgccgttgaacaagtttgtaattattcatatatccaaagacgatatcaccatcagccatgaatgataactcctcaattttccctcctacaacgggcattgtatcattcataccgctgacaattgcagcattcatattgcttcccatcgcttcaacaataagatcaagatgcgtattttgattcatgatccatacaagattatttgatgcataatctgtaaaaatcgttttcattgattttgtgatttctttaaacagttcaatacctgttttacctgtaattttgataatatttgatgttgataaatctttccactctctctcagttgctgaataatcgcccggcttctctgtttgcgcaagtcttgttacgatacccataggcattttgacacctttaccgtaaacaattgctttatcaagcgccttagcaattgcgataccgatagaattaataaactcctgtgcaagattaacatcattatcttctaaaatcgcattgcacattttaaagaatcctgacactttataaccgtcgacctcaatgtcattgaatcctaatgataattcattgatctttccgcattgttcagtccatactgcttcaggataagaccccatgattaccatacgtcctgtaccggtcaaaggttggaaatcagtatatttctgcagttttgaatttgtctctacgacctgcttaaccataggtaagaagttttgagggatgattaattctgtatttccaactgcacgtttttgactgaacagtgatctgatgtctcctaagaattttttaacatcctcacgagcaaataaagcatctctttcgtgaatatttaatccaaaaaatttatctcttgtatccattaaattattttcctttctttcttcattgttcttgtcggggttaggctgtggaattggtttaggctgtttttcctcaatctcttttatttcatcttcaatatccttgatttccttttccaaaccttcaattttttcttgatgttcctgtttttcagtttccagtttatcaacttcatcctgtactgctttttgctcctcttctgaagattcagggtttaattcctcaatagcagtttccagttctttttcacgggtttcaaaatcactgccgtttcttaaatcttccagttgttttgctaatccgtcttttttctttcttaacatcagtacttttaatgccattacttttctcctttcagtttctttcttagattttgctttaaagtttctatttttcttttgctgatttgagcaagatcgtttttccttgcactcacactggtttcttcataagccggaaatgtaactattgaaacttcatacagtttcaccgacttgattgtccagtgtacagtaccgtcaccgttatcagtaaattcctcgttttcaatatcgaaaccaaatgaacactgatcaacatcaccgcgcttgacacgctcgtatagattcattgcatcctgatcgtttggattgatctcaacttctccccacagtcctcttgaatcaattttcaagctcagcgtttcggctttattacgtcctaataccagtcttgtatcatgatcgattagacacctgatatctccgctcagctgaccgtcaaatgcatgtgcatctatactttcagttgcaccgggccacaattcataaactgaatcaaaaaccgagaaataaccgcttatataaagtctgtcatcctcggttctcgtcttaaattttgcatcttttccaagacttcgatatcttgtctttttagcatcattcattctgttcaccacctccatttaattttttctggtcaccgatcatccctgatggaatatagttttccagtataataagctcatcaagaccttctctaggcgaatatccgatcgagtctctaacctcatttctggaaagaataccacggctgaataaattacatccaacattggaaagtgtctcaatatcatacgcaaaaagagaacggtgattaaatctaaaatacagatttggactaatcaaaattacttttgtcagcgcctgttcaataacgttgcatatgtttttaatccgtgtattgatccagttattccattccttttcgttaaaactgcctattcccaaaacaaaagccggaatatccagaataccggctacagtttttttatcaagttcaacactgtccctaattgcaagatcatttaaagacagcggttttacggtcaccacatcgaactggtctgccggaatgatccagggctgacctgcatcgcttgactcgatatatttattaaggagctttgttcttccttcttttgttgaaaattcttctgtcattccgtctgccttaacgataatcgacggtttccatttggactccatgaatcctttttttgttgctgaagcctgttttaaagtatcagcaacctgtcgcagtgttttgcggtatcctgtacctttccatggaaataccgggtccggattgataggaatatgtaccagttcatcacatgtatactttactccgttatacatcatgtaatatccaaatccatccggaataaatgaaacctgtccgggaggcagtatatacagcccgtctatcagtccgtttcttgtttccggataaataactgcattcccgtctccttcaagcagcagaatcctgacaagcgcactgatgaaagttgctcttgtcatatacggattgggatttatatctatctttcttgataattcgttgatcagccgctgatcgccgttttcagtattttccatcagatgaatagtcatgcctgcaatcaggttggctgtcttgtttacagcgctaattatttcgggattctgggaaagcggtgtatatccgctgcttataagtacgtcccagttgtctatactgaatcctattgaccggcttccagattcttttgggacgctgcttctgcttttcttttttttctttgccatatattcctccttttaatcaagatacatgcttgcattcgatgatttttcacctgcgataagaagctgtttgcaggcaattacacttgcatcaaataaatcaattctctgagtaggcattactttctggaatctcacaaattcatcactgtcttcaattgcttttacattgctgacacagtattcatacgccttgttatgcagataataaaatttctttaaggtgtatttcttttcaatttctctaaacgcttctgttttttcaacatatctttgcagctgatctcttattttgaacccggcttttttcatttttaagataaactctctcgaatatcttctgtcatatcccacccattttatcttaaaacccatttctttcatttcgataaaccatttcacaacatcctcatattcgatcacatcactgttacaggttgtcagccatccttcctcttcccaccagaaaaacgggatattgtcttcatcggctttgagatgtgcaactgcaatcgggataaaggcatgtgtgatacatatatcaacatcgcggtagcgaccgtataaacagactcctgtcaaatcgtgaagttttgataaatcggcaccgccgtaccagttgactggtagttttgccagttcctcaagagtccagctgtatttaagatcacttgcctcaacaacattcatatcaaaataagtatcgatctgatttgtgaaaacatttaacgatttagcaaaaaaatccttccgctgctgcggatcattcattgcctgcatagcatcgttcattaattcttcaggtcttattgactccccgtatgcaggatttgccatttcatgaacttcgggattagtataatcaagtattttattgccgtccttgtcaacggtcatatccgcttcacagatgaaaacaaaatactgatcatcagttacttccttatcaagaattcttttgcagtatctgactctgtttgctaaaaaagaattgggatcatcgcccgcagttgaaataccaattaataatttattggtgtatgctttcatcatttctttaaaaagattgtactgtttcggctttttaaaagcatggatttcatcacatatagcaaagttcccattaaacgagtcctgactgtcggggttggctgccaaagcatttaattcaaagaaaccaccaccgatttcagccttaatcgaatgttcattgttattgtcaatgatatgaaaatgtccgccgtcttcatcatgctcacccatgttacgaatgttgtactttaaaaaaccaaaagtttctaatgtctgctttaatgcagctgctacaacatatatctttgatccgctgtttctgtataaaagaccaagtgcataagaaagtgctcctgcaaaagatgtcttaacatttttacgcggaataaaaataagcgcttctttaaatctgtttatgatcgttcccttttccttgaatccaagaaggttatatataataaatttatgaaatgtcattaaaaaaaacggagtacctcttagcggcgttccgtctcttttttcaccctgctgatgacagatagttttttcgataatattgataacaaaatctgcatcttttggattaaaatcccatttgtcattttttaaatcatccatgaatctttgacatgctttttttcgatatttatttgctcttatctttccagttatacatccctcagcatattcaagaacttcatcaaaatattttcccttatacatcctgatcaaagatcctgtctagagcactttttttattttgctcaagtcctttatttttaatcattttcaaaccttttggagtaagtccaaaaatattctcaagttccagaagttcttttcttaatgattcgatcgaaagataaattgcggtctttctttgattggttgcaccatttttatttgtatacggttcggtgacagcacacccactttcaatccatttttcatttaaaatctcatactgaagctgcatttctgcatatcttctgatcgtcgtatcaaattcaattttataagttcctaaatctttcattttatttgttgtatccttaataaaaccgttgattttttttgttcttgtctgcttgtgaattgccatcaccccctttcacaaaatgttctcagagttggaaaaagctacccaccccagtagaaatttaacgatatttaacgttttacaggtggggggattgcaatttttctttggttttattttcagattttaatatttttttattgtatttcacattaaatccccagcctttctttatcaatcttatctttatcaatacccagctgtttagcgatatcactgatactaatcaatccgcaattgaatgctaaatttaatttcataatattcaaaatgtttgtaagtgtattatctaatgaatctatctgtttatagatgttacgtagttcatcgtgtatctcactgtcattaacttccattatttttcctccattcaactcctggtacagttttctgcatcagccattttcctaaaggtgtcaactcaccagtcttacggttttccaatttattatgtgatttattgcttacactaatcagattccagtcacaccatgcatattcaggataatccttcgcaggatatatatgatgcactgtattggcttcctcactacgaccgaaccatttagctatctgacatttgtatttatcttttctcaaaatgctgtttcgtttctttttccattttccaccataatagtcaaacatacgtttctcctttgcagattattttaaactgccacctatgcataaaaaatgaaagcgaggtattttgctgcataactgacagtttaaaataaaagaaacccatataaatggatttcttccagtaaagtgttgattaactgttgttgtggtgttctttcaaaaactccacaatatcataataacacattttttcgtgaacattgttgcaactttacttttttttcaaaattttattaatttctttattaatattacgatacatagtacttctgtccattttgtgattctttgctgtttttgtgtgatttaaaccaatgcagtatatttccatcatcatggtctgcacctctaaaggaatttgatcaaacaatactcttacatcatatatcttacgaatgtatttatcacgctctaatattaggttttcttcatcaattagcaacgaatttattccctgcatactgaacggtattttattttcaatgtgatattcttttggtgctattgatttaacacctacaagctgtacgtgtatagcttccaactgattagtcagagatatgattttacgattgtaataaccgcatgatgttacatctctgataaactgttttctatcttccttggttacttcattttcttccattaagcctctcctttaatgtttcataattatctgcaatatagatatatgtatttatatccaatccactgtactcctgtcgttcatgactgtaaattgatggctgtttagggtaatccttaaacacatgattcacagctgcctcatatcgtttaatataatccgctaacagttcattacttatacctaaatcatccgttctatttatcttcattttttactcctttaaacgcgcaatatatccaagatgttatattgcatttatattttctctctaatcccttgctacataagcgattagagagatttttttattaaaatagtttttgttaaatttctaaatcctcctatgtccttaaatctctcttattgcttaattcataagcaatttgattttctttattgtagcctattggaatgattgatttaggaccgcttctgtttttctcgattaccagataataatcttctgcgcagtctttttcgttcctccagacaaatataaccttgcttgcactttgttcaagctcacccgaatctcttaacattgataaattaggctgttttgcatttttagttgcttctctgtttaattgacaaagtccaataatcgtacagttgttatccaaactcatttttcttagctccttggctacttctgtcattttttcataactgtttttagcacgtacaccaataagccctacatggtccacaaacactataaaatgcttatcgcttttgtagctcataataaacgatcttaatttatccaatgttgatgaatgattgataatatcaatatgtctttttgaaatatcatcaattgcatcattaacaacgctcatatttttttgtggcaatgtttcataactctctaacattttttgatttaattttgaattaattgaaataagcctttgatacagctcctcttctaccatttcgaaattgaaatatacacaaggataattgtgagacagatcatctaatagatttatagctatacctgatttacctacaccggtagcaccggcaagtataacaaaatcattctcttttagatttagtttcttttccaaaattgtaaatctagtaaatttgatattattcttgtgtttagtgatagaaccttttaacagttctttagtaagcctcgtcgatgaataagaccctaaagatgcaaaattgtttgtatccttgtaaaattcatcaattgtaatttcttcattctggagctttttagcagttgccaataaggctttctttttatactccttaatcgcgtaatcctgatactgttcaaatagagcagttgttgcggtacttgtagaacaggcaataacaagatcaacatcaattccctttactgctaggatatcctctaaaataatagttttattttccttatacgacttttttatagcagtaaatatatcgcgatgcttcttatcgaaatatgacggttttagaatagttaaatccagaagctgcggtttaacaagaaacataccgattagatcatcctgataattattcatatccgctcatccattcattatcatcatttgtattgtttttagaaactgtactgatttcatcttcccatctttcgccgttaagccatgtggaagcgtgagggataaatctttcattctgccactgttctgtctctttataatcaacaactgcgcttaacatcttttgcagtacagtttcatcggtacattttttaacaaaaacatcaaatgcttttttcttgttcgtatgtctgggatatacactccagaatcttttaaatgcatcatttttatcaaattttgcactatatatattactagtattatattctatattattgggtgaacttttttcaccacccccgtgaacttttttcacccctggtgaactttgtgacactactttgtaactgcaaaatttaacaccatttttctctttttcttctttgataatcaatccgttttcaacaagaacatttaatactttagttacatttctttttgtagtattggtccaatccgctaaatattgtctactcccagtataagaatcatcgccattttgtgaaaagccgtaaataattgcataaataagcagtgcacttccacttaatcctaattctgaaaccatccatcctaaaattgttatgtaattgctttgtctaactttagtctccatcattaccaccgatcctgttttttaatctctgtatctttaattcagcattgacctttagttcagtttcatcgataccgaaaataaatttaagctgttcaagcattatgtagacatctgccatttccatagctatatcacttctattctctttacctctgcggtctttaagcagctcctttgtaagttcgctcatttcctctatggccatatcgacctgaggaccgttcccgtaatgttccagggcatcaagcattatgttaatttggtttgtgttaaattccatgctgtttcctccattccttaaatagatatctaattcccaaaacaagagacaaaataaacgcaataagcataattaggaaaaatacgaatgctatttgtttagatgtcattttcctttgcttcccttgttgacttaacatatttatcacgcagtttcgtaattagttggcatttttcacatgtaccgattttcttttcttccttgcatccccattcataacagcaatcagtgcagattttatctacaacaaatagatcataaaactcttcatcataaatagtctcacgttcttcatcagtaaatgtattttcaaatactatatgtatttcttccatacctttaaaaccaattctagcgtttttgtatccatttttttgcctaatatcaagccaccgttcaatgtgctttagaatattttgtttatccatcttctttcacttccattttaattaaattagcgtattgcactggaaagaaacggttttcttcaaatgcaccatcttcgcaagttccatcactataactacgatgtggatatattccagcgataaaatctattctacaaaattcatcatatttaatatcataaacccacatatcctcttttaaatcttcaagtttgtatggtttgtttaaatagatattttttagctctgcttcattcttaactccaaaatgtttacaaaggtttcttattgtcattttcatacaatgtgtctcaaaacgatagtcgtggacatcatcaagaatttttgagtatttttctttaagttcaaaataatcatcaattagcatattatataatccaatattttcaatttctcgttcagttacatcatcatctaaaaaatcaaatagagagaaaaatcgttgtgaaagttcataatatctttccttatattcttccttactcaacattttcttttacttcctttaactttatctttaatgtttcaacctctttttctaattcattagtttcagcaataacctcatccagcttttcactcagcagattaaatccttgtattaaagtgtctataacctctgcatgtctatcaagcggtttataataatttcttcttattttcttttttaataatttaatcatcttcatcaccgcccacaatggtacagttagctagaatttcataaatttcccgcggttctgcatcttcccacttaatgaaactgaataaaccgaaattaaatattaatgagaaatcccctccatcactccatgcaatttcttttttatccggcttgtttctataaaaacaaatctccccatcaaaatcacatgctacaaacctgtatcccagttctcttgcatatctgagtattctgaattcaagcactgttaactcatatggtcctttatattcttctaataaatccataagcgacagctttaagcaatctgagcaatctatacctattctataacaggtatcatcgtaattctgatttgttgcaatccgagataaataacattgcaaatcctcaccggaattcaccgtatcaaaatttttaattatatcttttagtctttcaatttttaacattttttcatcctcacctttccggtttcaacacctgtaaaaaaagttacataatccctaagagtgtcaatttttttgatagataacctaaatcgtttaaactctacagccatcaacactcttggcaatttttaatcaattaaatttctaaaaaaagttaccgtgaccccgatttacgtaaaatcgcacttccagggtgttactttctattttgtaaagtccactctttccactgttctttgttttttatatcaacaaaatcaccatcgttaaatgtcatatcaaatacttctaattcttcacacgctttatctaatgcttgttccaactgttcgatatattgttttacaagctcatattcatcttcaaaataatcaccagcattatcaaacagtgctttcaaatcatgcattacttcacctttgtaaatcgttactttattctccatcaaatccaccccttatttacaaatattttaaatacttctctaggtgataaacattgcttttcgctctcctcaatcgctttataaatatggttgcaatcaacgatacgacttaatgcaaacttacctctaaatagcacatttgctatgacatatttttccttaacgcctctatacaacatacaatcagaacataattcatctaataaaagaattaactctgtttctaattttaattgctcttccttactcaacattttctttaacctttaacaatccttgtttataatttttactaaaacgtgattttccattattaatccatttatacccttttggattagttgttgcatcttttattattttccaatcttttggtaacttgtcataaacaattacaccatttttacataatttttctaacacttcatcagcaacattattttccatcattcctatctcctaattaagatcctgcactcatcagataataagaaattaagtgataaatttgatctgactaatccacaaactgaaattttcataataccataattatcaaaataatatttttctattttaattgcctgattactaaaataaaattgttgaaacttttttaaatgaagtttctttctaattaaaaataaaatcaatttatttaacattttcatcatccttttctttttgtcctaaataatcaacaattaagatcgttattattgcttctgctgcgatggttaggattacccctaaccaaaaatcacttatcatttatgtactcctcctaagtaaactgcttctctatcattttccgcatcttctttaccccaacaaatatacaggagtgttacattgggttcatcgtggttatacatcttcataagagttagaagattaccaccattggcataatactgatatccgaatgtttttcttaaactgtgcataccaaaagtaaaatcgatgcccacttccttcgcatttctagatacaattttatgtgcacgctgtcgcgttataggataaacgtatttcttaccgttctgaaccttcttttgtccaagaaacaaataatcatagtctgttagattgtttctatttatgtaatccagaacatcattatgcagtttcttattcatcttaaaattttgcatcttggcggtcttattttcctttatatgcacatatcctttttttacgtctattaccctcagctgaagcaaatcctctgctctgaaagctgtattaaaacctaacatgcacatcatccagttgcgatcagcttggtattttttgattggcgtttttgctttgtctcttttccttagaagattgaacataaattcatcaagctgctttttgtcttttattggtaaggtttcatgctgaccgccaaaatgctttattcgtcttgccaatttatcacccctttggtgcaatataacctaaatattatattgcatttatattttctctctaatcccttatgtaccaacggattaaagagattttttaactaaaatagtttttgcagttttaaatacttgaatttctttgacctccaccttgtgatataataaacaaatgaaagtgaggtgaaaaaaatgtcaaaaaaatgttttgtggtttgcccaatttctgacgaacaaactgatattcgtaagcgttcagatcagttacttaaacatataatcacacctgtatgtcatgcatgtggatttgaaaatccggaacgtgtagatctaattgcaaacccagattctataacaaataaaatattagaatgtttatcaacttacgaccttgtaatggttgatataactgatcataatccaaatgtattctatgaattaggctatcgttcagcattaggaaaaccattaattcagctaaagtcgaaagctgattctattccttttgatgtttctaatatcaatacatttgattatgctttagatgatctagatgaggttgaaaaaacaagagagcgtttaattgcaacaattaaatcattcgattttgataatttagatacaaaagcaagtagtaagccaataaatcaacaacattatttatctaatgttttgcaggaactatatcaaataaaagatgatatcgaaatcataaaagagcaaacaaaatcaacagatataggtgctatatcagtattagctgataaactaactgccaatagtcaaaaaactgataatcaagttttaatggaaactatgatcccaaaattacttgataacccagaatcttttatggctttattcgaattatctaaaaaaataaataagtaatatttaaagttttatttcttttaggatttccttaaacattgcttcaaggaaatcttttgttttccaaattttctgattgtcgatattttctattgaaacagataaaattattttttctttacttttctcaaactgtatacattttgaaactgtcttgctagttgtctctaacatctttttatttctcactttcttttttaatattcaaatttaccgaaccagtagtgatctttgttgataataactcttgtaattttcttctttttaaatatctttctaaactgttttactgcctttttataggctgtttcccttgtttctgcataaataaccaaggggagtacaattacctcactttctatgtaaatgttgtatttaaacatcgccttctatgcctaatctgccttcaagctcgataatatattcattgttattaataacctgacattcagctgctctcagtttttttaacacttcatcaagattattttcaagctgttcaatgcgtgtatgcgcctgcttaagttcattcatcacataggcttctgtacttttgtatttatccatttccacacctccaaatattcagttttaacttatttttatttgcccactcttttacaaattcctttacatgatcatctggaatataatcatttttaccatagcactgttttatctctttttgcttaagctccaatgttacatacggtctattcggctcttctttttttcttataaagaatatttctgtttgattttcacaaaccctgtctatgtactgcttaacgcagtggtttaatacattagattcctctataagctcaccactgtttctgcatggacaaattaaataattatcgttaaaataaatatatttatcgtattttcgagaattactgagtattttcttatccttttttttatttctagatacgtgtatttttttatttaattcatcatgtgctttttttaagtctgcggggtatcgattggatgaattcataatcattgcaatctctctacccattttgatatagtcggtgtaaagatttattacattgtttatggaatacgatacatatctgcccgttgcaccgtatagattttctttaatcatttcacactgcctgttcatatagtcaaagagcttttgtgttggatttatgttacattcaataagtgttttataaagtacgtattcaggcatatgtttaatcttatatttccttatccactctaaattttttctaaattcagttaaaggaagttttaaatgccttaaatattctatatcgttcttatctatccctaaaaattgtgacataggtttggtaaatcttaatccagatgtatttcttattagatgctgcagccccatcttggccaacatttcaatctgttttggatgatcatcatatttttttaaatacttaaacagttcctctaccctgtaatcggtaaattcaaatgcacagtatttatgcatcgaactgtctagaaaatgcctgtaatcattgtgttctacgaccttatattttgtgttgtcataaaaaatataactgtctacattgttcttttcccagagcatttcatttccatttacattaacggtgtaggtaaagtagtttctataccagtcacctgtaaggattaaaataccaccaaaagatgatgcataaactctattggtaaccatctgttttagtcctgccagttgtctttttacttcgtaaatatacctgtagaattctttattttcgaatccctcttcgatgtaaaatgagcgacatagcaaacgttttttatatgtactgtaaatatttactatttttgcattaacaactctttttcttttagatctgccgatttcttcaggggtagcgaaatactgtttaaaataattctcggaatatttcctaaaactgtgatgttcaagttcatagagcagtttctcttccattttcttttccattaaaacagactcatctgcccttctggaatatccggtttctttatttttttggttttaggcttagattcaactgtttttttactttcctgcttttgcttatctacacctgatactgttttcacatttcctgaaagtttatttatttttatttcatcttcctgataatagtgaagagccatttgatacagttcgtcattatcccatccaaaatagcggttattgactgcttttttataaacttccccggttatataatcggcacactcgctcagagatttattttcttttgctaagttagatgccaaagttaaatcctctttagcacgttcaagcaaatatagtcctatccctttttcaagagatccgtctttgtatttttttatttcttcctcgattttatccataaaatccctccttttacctaaaaatggtgcaaataaaaacagtaccctaaaaacactgttaaaaacctatatattttttattatcccgacgataaaatcgagaatgatacctgaagctcccgcagctataaaacctaccaaaataataattaaaacgattgtataaaagcctctggcattaagcctgttaatgtatttttccattctcgatatcctttattagattatcgacaagatatgagcttatgcctacaattgaaggatatgtagattctttacaaagagaaaatcccgcagcatccggatacgcttcgataagctcctctaaagtgttagaatcaacaacgtgttttatttcatttaaacgttcaataatttctttattcacctttgacacactcctttttatagtctataattaacgtggtttcattgattagctgctactggacatagcagcttttttcatgtgtttttcatgtgctgttactgtttcaacataattactcatgcgttcgccacgatattccctttgaaaatctagaatttcttcttggctaaatttccaaccttttcctaaaaaaatcggattaagcaagcctaaatcaataaaaatgtttagctgtttagtagaaattcctaaatctgtcttaacctgctcgaatgtaagcattgctgtaggtctcatttatatcaccctttttttaatttattaatctcattaattgtaaaatcacacgttttgcgaaatttatcttcaatatccaataaatgccttaccaataacaaatgtgttatcaaataagaaatggtcacacttattgttatactaactaatatacaatccatactatgccccctcattcacgcttgaaatttcaatttgtagattatgatccggtctccatccctgcaggtattcttttgccttttcgaagtctatctttagggtatcgcggtaacttggaatcttgaaataatccttgtaatctctccataactgacagaacactttatgatggagctctaaatacgcttgactgtctttacctcccaagactctaactgctgttgcactcgctatttttcttagtgtgtactgctttctactgtctacagtagttgtgttttctagattagttacgcgactatcgataaccttaactctgtcatttgtttgctcggtagcttcaaacatcagcttaagagcaatcattggatcgtcagaaacttgatagacaccatattttctaattgatggtaaaacctcatttgttacccaccttttaaatttttttgcagttggcaatttactggatagtattaaactgtataaccctgattcattaataattacagtatcttgtgtgccaccttgggggtgaacgattcgttcagtccttttatcatcttcatcaatatgatctctgatggccttttgcggattgctataacctagaatcaaagcaacatcctttccaacaaaacatggttcattatttattaatagacttctcacttctccaaattcttcatttttaaatatttgtaattgattcataaaatcctccttagactattttttatgtgttaaaacatatatacatataaattcaataaatacacagagcagtaaaaataagattatccagatcatatcaattacctaatttctttatcagcatatacatcagtaaatcacgattatcgcattctttagccagtgcaatcattagtctgtatctgcttaaatttgctccaatcaaatcatcaaaaccgtttataaacccatttccaagatttaggctaagcattgttttagccagttttatttgacaccactcattgcatgaaagattagatttcatgtaatcatcaaattcagcttctgtttctataagtttatagttacccttttctttaaatatttcctttgctgtcttaacactaatgacctcatattctaaaatatcttctgaatcaataaaccatctatcatcatgaagtttaaattcaataatcttttttgcttttctcttttcctgattcacttttcgttcaacacactcatcataagtgttaggaaatttgtcatcacaatatctaataattttgaagttgtctttatgattggtttcaataatttcatctttctttactgttattgaaaaaccataccaacccgatttactataaatgatggtgaattcatcctgatcaattaaatccttttgttttttaatcatctaatgtcctccttttcattcttttgaatccgttttgaataaatcatcgattgatacatctaaggcagaggcaattattttaacttctgcaattttaagaattcttctgccattaatagcatcacaaaaactttgttcactgaatccagctaattgagctatttttttctgttttagtcctttttcatttagaatttttacaatgttttgcgctactggactgttataatttattatattatttgttctcattactcaacctccttttaaataagttcggtttactcaacctatatcatcagtatagtcgagttttacaacctagtcaatattaaaatacgaaattatcaaactttttttattgacgttctaatatttcgactttataattttatttgtaaagagacggggtgaaaacatggcatttaaagaacaattaaaagcagcacgattggcaaaaggatatactcaagaacaattagctacagctataggagttgctaaatcaacatttactggttatgaaaaagggaatagcgaaccaaatatgctgactataaaaaagttaatggaaattttagaagttgatgctaattatttatggtatgacgaaaatgacaacagtaattcatttgtgacatcttttattgaacaacaaatcataaaaaaatatcgtttaattgatgaaactggaaaaaatacagttgagtttgtattaaatgatatatatgatcggtgtgttaaagagcctgctccactatatgaaacagtattaaaacctgcttatcagtgtggtctaagcgcaggtactggtttatatgcttttgatgatgtaccaacagaacagatagaagttccaattgattttaaagatatagacttcgttataagcgttagtggtgattcaatggaaccgacttaccgtgacggtgataaagtaatgataaaaaaacagcgtgatattaaaattggcgaaattggagcatttatggttaatggtgaggcatatataaaagaacttggtaacaaatgtttgatatctcataataaaaaatacgcaccgatccattttaacgaatcaatgcgcatagattgtatcggaaaagttatagggaaattataaactccagaattaattatatttagatatgaaaaagattcaaaaatcattaaaagaaaaaaaatctattttatggataattatatttacattactattactttttatcggtgcacccttatttaatgcaattgcaacaaataaatggtcccttcattttatcaatgagaataattatgatgcttggattggttattacggatctgtattaggcggcgctttaaccctaggtggtgtttggtggactattaaagaacaagataatcagcgaaaagaagacaaacggattgaatacaagcctattattcaaataaaaaatcattataaagatgccattatcaataataacatacttacagtatactacgaaataacaaacataggacgaggtgaagcaaaatatatagacttcaacttacaaccctatttttttaaagaaaataatatagataaatatccattaaaacttttacaatatcaaataactaatttagacattttaaatattaatgaaactaaaaatataagagtaaatattgatgtaagtcccatagactttgagaattataataaattaattaatcttcaaataaaattatcgtataaagatttatatgaagatattatttattatacaaataaatccgataatataactgtttataacaatatggaaacagggggattttggaaaattgctgtaaatgttacagaaaagaatggtaaaactttaatcaccgatccagtcattgaaattaacgaataaaaaagaccaccttttacgaggtggtctaacagtagtatagttataacgaattattccaattgcacactgttataactatgctcctattatatcaaataaaggagttgttttaaatgtcaattagagaagtaaaatcaaaaaaagcaaaaaaaggagttacatatagagtttatttcgattataaagataaatatggaagacctcagcattattcaaagagtggctttgttaaaaaaacagatgcacaaaatcatgaaagacttatatattctaaaatagttgatggatcgttgataaatataaaaaaaacgtttggcgatgtctgggaggaatatatagaaattgatccccacacttcagtgactacaaaacagattcgcagttcatattataataaacatatacgaccacagtttgaggatgctgatattacacttcttgattacaccataattcagaattttgttgctgaaaaaggaaaggagctttccaaaagtacagttgaaaatatagtgaaggtatttagcggagtgtttaaatttgcctataatcgtaattatatagaccgtctgccatatgcgcggttaaaaataaccggcaaagccaaaaatgatttgtttaagaaaaaaacagttgctgaaaatgaatttaaagagcttctaagcgttgttgataaaaacaggtctatcagataccgctcatataaaatcgtgtttatgcttggatattatatgggattaagactaagtgaagctctagcgcttgaaaaaaatgatgtagattttgaaaatgaaagagtaatgattaccaaaaatatatttaaaaacaacgaaacaaaagtacttgagattaaagagacaaagactcccgcatcctgtgcgattgttccattgccttcactgcttgttccaattttaaaagcatggtttgctgaaaatgaaagcaatttagttgctcccgacaactatatgaacttattagatccgcagactgtaaaaacctttttagaacgatatagcaaacgtacaggggttcatataagcagccatatgttcaggcatacttttgctacaagattgtgggaaaataaagtagatgtaaaaattgcgcaaaggctattaagacatgaaagttatcagaccacactggatgtttatacatccttggagaacgaaaatctaaacaatgttgttaataatgtgtattcataaaaaagacattcctaatgcagaatgtcttttttagttttcctagatatgtttaaaaattctatctgaataaattaatgctatcatctattttagaccagttaacaacctgaactccataatttgccgtagcatcatatatactatcatcgacattatttgaatcattaatcaatactataaattttgtatcattttttctcattggtctagtatcatcccattcaaacaaagccatcttaatagttgattttgatgcattgttaattagcttacacaatctttcaggcttattttttgaacgctgaaataaaaaatcaaaattagaagtatatccactctttccaatgaaactaggattttccgtgtagtatatatcatttttattaaaatattttacaacatcatctagaaaatatgacttaaccttactactagttgtaaaattcatatcatcaactctcaaaatacattgaataagagaattcaatctatttgaaaacttatctttggttgttctaattgatatcttatcgccatcaaattgagcaccaaaagtcaaacatgttctttcaatttgttttattctattcggactcataccaacaccattcatttttaaatttccaatggtatttccatcatcatccatataaatattattattttcaaattttgcatatatctgtattgcatcaccaataaagtcataaaacggaacagtaatttcataatattcatttaatttaattgtattagtttgagatttcaaaaaatcataataatcatttataagttcatccatattactattcctcctttcgattaattaaaaacaaaacattcctgatgtgttttaggataatttatgacatttacttttttcataaagaaaatacaatcatctataaacgaaccattgcttttacactccatagcatcagataattctatattttctttaaaaatatgcagatgtgaaccatgaataattttaccattactattcttatgtgaaagtgtactaccaatatctaatcttaataattttatatttgacccttttaatcttatctgaatactatatttatctctattttttgattttctatatatattaattataaataaatcatgactagtcagactttttacttcatattctttagtctcaccaatatctggataatatatcttgttatctataaactctttcaaaacagcaattaaattttctgcatcaacttcactcataaattacaccatcctttatttaataataatataactacaatacaatatcaaataaaaaaataaattaacttatcatcacaaaaataacataaaattcattatttttcactttaaattttagattttttataaatcaatatttaaatttttagcaggaatttagcagttaagcaaatacatagctgtgctatacctactacataattgacgattttttaggaaataaagaaaaaaggtataacatagctgcaatatagttatgatatacctaaatttctttaatttactaacccatacggttatagtattcaacgattaatgactcattgatttcttgatttaattcagatctttctggtaaacgagcaagttttccagttaatttagtatcatcaacttctacaaaagcaggagtatgtactctagcttctaagctagctttaatgattgctaaatttttagatttttctttaacttcaataacatctccaactttaacgcggaatgatggaatatcagtcttaattccatttactaagaaatgaccgtggtttactaattgtcttgcagctcttcttgtaggtgcaaatcctaatctgtaaacaacattatctaatcttctttctaataagcagaagaaattataaccatggataccttccattttacctgcttgtttgaatgtgttatggaattgtttttcatttactccatacatatgtcttactttttgcttttcagctaattgtaaaccatattctgtttgtttttttcttttttgaccatgttgacctggagcataagctctcttatttaattctttaccattttctaaagtagagaatcctaaacgacgagataatttccattgaggtcctgtgtaacgtgacatttgtcttcctccatttattgttttatttgcataaaacaataacattgcatagattatttgaattgtgtttatattaagtatttcactttgcagctagctactctacaaacttaagttataaacgctcttttcaaaactctatgtgctgctatcatttgttgcttatttactatacctttttttattgactacgtcaacatttttttctaaaagaattttttctttttcaaaattaacatttcaataattacaactaaaatacttgctccaataacaataatataaccataaggattatttaactctggcatatttttaaaattcattccataccatcctgtgataatcgataacgggaagaaaatagttgttgcaactgttaaaacagtcataattttattttggtgggtatcaattttattttgatacatttcctttatttgcaaagaataatcttttaaagcatttaactggttatccaaacgatcaatcctacgtgcctgcatgctgaataaatgacattcataatcatttaagaaatctgattcattatcacttaaaatatcgatcatatcccccaactgattataataggaatttaaaattaatagttctttacgcagcaagattatctcattatttatttgactattgaaattaaaagctattttgtcttcgatgacctgtaaacgatcagcatattcttgtaaatacattccatcatcaacagttattaagaaaatcaaatcatgaaaaaatttgttcaaacttagacgattattagtatatgtatctttcattttttcaataagtttcatcacataatcgttatcatcaataaaaatcattttttgttctgttaaataaaaactaaaacaatgttttatttttaaatcctttttgtcaggtataacaaacgctccgcaaatcacatcgtaaaataattctactttacagtacataatatccccaatatgcctaatcacatggtttgcatgattttccttttgatactggtttatgaaatcttctttactaagaatatcaataactaagcttccttctttataactatttgtaatttctttttctaaataataccgcattatctcacctacccgaataaattatagcacattaagtcaacttagttgaacgttaaccataaatatgataacctattaaacgaaagcgaggcaatacatatgcaagaaactgtattattatacaatattgataaaactgatgctggtaaagcaattatttcaattcttgaaaaactgaatgttgaagtaatcattgttaaatcaagtgatttaatgagcccgattgggtatattttaggtgctgataattttgaacgtggaactgaagcattaacagagattccacaagatgacatgatggttatggctggttttgaagataaacaagttgatttgctattacaaatttttaaagaagcaaacattcctttcattccgttaaaggcaattgtaactcaaacaaatgtaaattggacatttatgcaattgttgaaaaatgttaaaactgaatatatggaattaactggaatgaataaagatatgatcaactagattatttgtcttgttagcagtatctatatcagcgttataatattttaattattattaaagagattatttgattcttagaagattaagtttaatcttcttttattttgttaaaaataaaagtggaggtaacttatatatggaaacaaaaaccaaaacaaatttattaagagcttttgctggtgaatgtcaagctcgaatgcgttatgaaatggctgctaaagtcgcaggtaagaatggaatggctattttacaagatatgctttattttactgcaaatcaagagaaagagcatgcgatagttttttacaattatcttaaagatgtttttaaagatgctaatgtttcaatggaggctaattatcctgttgatctagatcaggatttaagttcgttattagaacaagcagcacaacacgaatacgatgaagcaacatctatctacaagcaatttggtgatgaagctaaagaagaaggttatgttgaaattgcaacaactttttacatgatttgtgagattgaacactatcaccatgaacgttttaaaaaatatcataatttattaaccagtggtaaattatttaatgaccagtctactgtaaaatggatgtgtatgaactgtggttttatttatgaaggtactgatgcactaacgatctgcccagtttgtaaacacccacaaggttatagtctacgtcttgatgaatctcaatttcatttataaactagtaaaagcaatcctcttgaaaggattgctttttaagttaattttttaacttgtctaaactatttaatattaattataaaaagtctataattaaaatatagtccaaaaaaggagtttaattcaaatgagaatactaagttttaaaggcggaatccatccccatgataataaaagtctttccgccaatcatccaatcaaactattaaatcctggagatgaactgatttatccattatcacagcatattggtgctccagctaaagctatcgttgctaaaggtgatcatgttttagttggccaaattattgctaatggaaacggtatgatttctgccaatgttgctagttctgtctctggaaccgttaaaacaattgatttacgacttgcccctactggtttttttgttgattgtatcgttattactaacgatcaccaatatcaaagtattccagaatacaacacaacaaatgattatcataattatagcagtatgcaaattcgtgaacttatcgctcacgcaggaattgttggtttaggtggcgccggcttccccagcgcaataaaaaatacccctaaagatgatgactcaattaaatatgtaattatcaacggtgcagaatgtgagccctatttaacttctgactatcgtttaatgctagaagaaacagataaattaatcgctggcatcaaaattcaattacagttatttaaaaatgccaaagcaattattgctattgaagataataagccagaagcattagctcatttaaaaaaagtcgttgtagatgaagataaaattgaaatagcagccttaccaacaaaataccctcaaggaagtgaacgcgtattgattaaagtattaactaatcaaacaattgtaaatgggatgttgccagctgatgttggctgtattgtcagcaatgttgcatctattattgctatctatgaggccgttgccttaaatattccactaattgaaaagattgtaacggtaactggtgatgcaatctttcaaccacaaaattttaaggttcgcctaggaactaaatatcagacccttgttgacgcttgtggaggttttaaagtacatcctcaaaaaatcatttctggtggtcccatgatgggtactgctttatttaatttagatgtaccagtttctaaaacttcttctgctttagtttgcctaagtgaagatgaagtatctaaaaccgctccaactgcgtgcattcactgcggccgatgcgtcgatgtttgccctatcggtcttattccacaattactataccgttatgccagaacaggcgataaagaaaactttttaaaggttcacggcaacgattgtatggagtgcggctgctgtaccttcacatgtcctgcaaagcgaaacatgacacaatcatttaaaaaaataaaaaaagcaattaatgacgatcgcaagaaaggagcaaaataatggataatttatttaatgtgtctactgctccccatattcgtagttcaattacaactaaaaatattatgtatgacgtaatcatttctttattaccagcaactttttttggaatttatcaatttggatttaatgcgtttcttgttattacaactgctattattacagctgttctaagtgaatatttgtatcaacgattgatgaagctgccaatcacgattaaagacggctctgcagccatcacaggcttattattagcgttatgcctatcaagctcattgccattgtggatggttgctttgggaagtatattcgcagttataattgttaagcaactttttggtggacttggtcagaactttatgaatcctgctttagcagctcgatgttttttattaatttcatttgccggaaaaatgaacagctttgttagcatcgacgcaagtactagtgctactccgctggcaatgatacaaaatggacaaaatgtcaatcttctcaaaatgtttataggaaatactagtggtacgattggtgaaacatcagtaattgctctgcttttaggcgctgtctacctaatttatcgaaaagtaattagtcctaaaataccgttgtgtatcctattttcattttctttaatcattttgatcaataataactttaacagtctatttttattacaacaaatttgtggtggcggtttaatgattggggcatttttcatggctactgactatgtgacaagtccgattactccaaccggtaaaattatttatggactggttattggaatattagctgctgtttttaggctctatggtaatactcctgagggaatgtcatttgctattatcattactaatttacttgtccctttgattgaaaaagtaacagtgcctaaaataaaaggtagtggaggtaaagcataatgaaaaaaaatcttctaaaagatattctcgtttttgttgtaattacagttgctgctagtttatctctagctatggttaattctattaccaaagacccaattgctagacaaaatgaaaaaatcatacaagattcttatcgaagtgtttttaaagaaggtcaaaattttgataataataaacaaataaatcaacttgttaaaaattttcctaatgttataaaagacaaaaaatataactttggtgaaaatggcattgtgatagacgacgttttagtcgttacaaatgataaaaaagaattaataggacatgttgtcaaagtcactactgaagatggttatggcggtgatatcacattagttgttggaattgatactaatgatgaaattacgggaattgaagtcctctcaattgatgagacggttggattaggaatgaatgctaaaaatgataattttaaaaatcaatattatcataaatcagtaactgattttaaaatcaccaaaactggtaagcaaaatgaagatgaaattgatgctctaagcggagctacaattacttcatcagcttttaacaatgccattaacggagccttagcaatcaaccaggaaatcaaggaggctaatcatgaataaatatgttgaacgtctttataatggaatcataaaagaaaatccaactttgattttaatgttaggaatgtgtcctactcttgcagtaacaacttcttctgtcaatggattaggaatgggcttaacaacgatgattgtccttgccgcatcaaattttatgatttcgttcttacgaaaaataatccctgaaagaatgcgaattccttcttatatcgtaattgtcgcttcaatggtaacaattgtccaattactattacaagcatatttgccttcattatatgatacattagggatctacattcctctaattgtggttaattgtatcattttaggacgagctgaagcttacgcttcaaaacatagttgcgttttatcgttatttgatggtgttggtatggggctaggttttacgcttgcactgacttgtattggtttaattagagaaatgttgggcagtggtactttttttggaattgagtttgcgccactttttaaagatttagttggcactaatatttatagcttttttgctcatcttgaacctgtaactatctttgtaatggcacctggcgctttctttgttttagctggtctaacggctattcaaaaccgtttaaaactgccaagtgcaactaataaaaacaaagatggtaattgtaatcatgattgtcttcattgtcgtagcagtgatgaaaaggcactttgtgatttaaaggaggaaaaataaatgacgggaatgattttattattaattagtgtcgctttagtaaataatgttgtcttaagtcaattcttaggtctatgtccttttttaggagtatcaaaaaaaattgaaacagcagcaggaatgggtggtgctgtcatctttgtaatgtctattgcttcaattgcaacaagtttagtttacaaaatactagtactcttccatttagaatatttaaacactgttaccttcatcttagttattgctgctttggtgcagctagttgaaatgttcttaaaaaaatatagctctggcttatatagttctttgggagtatatcttcctcttatcacaactaactgtgccgttttaggagttgctatcacaaatgttcaaaataattatgatattttgacaagtcttgtttgtagttttggaacagctgttggatttacgattgccatcgttattatggctgggatacgtgaaaaaatcgctgataatgatattcctgtttcattccaaggttcccccattgtactaatcacagcaggactgatggcaattgcattcattggcttttcaggtctaatataaggaggagaatataagatgaatgaaattataattgcggccattattgtaggtgcaatcggtttacttattggtattcttctgacaattgctagtgaaaaatttgccattactgttaatgaaaaagaaattcaaattcgtgaagaacttcctggaaataattgtggggggtgtggctatcccggatgtgacgggctagccaaagcaattgttgctggtgaagcaaagatcaatcaatgtcctgttggaggaaaaagtgtagctgacgccattgcaatgatcatgggagtagaaagtgaagaaacaatgcgaatgacagcatttgttcgttgcggtggtacttgcgaaaatgcaacgattcagtacttatatcacggtatcaaagactgtaataacgcagccatcgtccctggtggtggagataaacaatgtagtcacggctgcatgggatacggcagttgtatcagagaatgtgaatataatgccatttcaattattgatggggttgccgttatcaatccagacttgtgccaagcatgtggtaaatgtcttagagtctgtccaaataatgtaattactttgattccatatcaaaaacaggcagtagtaaaatgtaattcaaatgaaccagctctccgagctcgtaaaaattgcgctgttagttgtattggctgtggtatatgtgctcgtaattgtcctaataatgcaattattattgaaaactctttagcacggattgattatactaaatgtacaaattgtggactttgcaaagaaaaatgtcctcgaaaatgcattataactgcttaaaattatattaatcaaatgaaaaaggtgactttgtgtagtgaacttcattgtatcaaaaaatcaccttttttacttatcacttttcacttatcataaaattactaattaatctactctatacttcattcttttattatacttattttcctctattaataaatatgttcagtacagtaattctaattatcatctcataaactactttaatttttctcttgacttgaagtaaacttcaagatgtatgatattatcacctataaaaagtattttttatagtatctagttatatgggaggtaaatatgtttttagaaaaaatagacgatacaaacgatcttaaaaaattgaatagaaaagaattaaaagaacttgctaacgaagttagagcagcattgattaataagattagtaaagccggcggacatagtggtcccaatttagggatggtagaaatgacagtagctttacattatgtttttgattcaccaaatgataaattcgtttttgatgtttcccatcagtcttatccacacaaaatattgactggcagaaaagaggcatttctagatgaagaacatttccatgacgtaacaggatataccaacccacttgaaagtgaacatgacatgtttacaattggtcacacttctacatctgtatcacttgctcttgggttagcaattggaagagatttgaataaaaaagccgaaaatattatcgctattattggcgatggttctttatcaggtggagaagcactagaagctatcgattatgcaggcgaatataataaaaacttgatcattatcgttaatgacaatgatcaaagtattgccgaaaatcatggcggtatttatcaaacgcttaaagaattacgagacactaacggaacaagtaataacaatatatttacatcatttggtcttgattataaatacttagatgatgggcatgatatcgaaaaattaattgaattatttgaaagtgttaaaaatatcgatcaccctatcgtattgcatatccatacaatcaagggaaaaggattaccatatgcagaggtaaacaaggaagcttggcatgctggtggtccatttaatgttgctgatggaacatataaatttgttgatgaagatgatcaaaccctattcaatagcttgactaacttattaaatgcaaataaaaaggctattgttgtaaatgccggtacaccgatggggctaggattcatcgaacctgtaagaaaagaatatgtcgaacgtggacaatttattgatgttggcattgctgaagaaaatgctatggcaatgattagcgggattgctaaaaatggcggaatacctgtctttggaacttttgctccttttttacaacgtacatatgatcagctatctcacgatttatgcctgaacaataatccagcaacaattcttgttctatccgctggagtctatgggatgaattcaaatactcatatagctttatgtgatattgcaatgtttgcacatattccaaatttaatctatttagcgccgacaactaaagaagagtatttacaaatgtttaaatatgcaactacccaaaaagatcatccaattgcaatcagagtcccagtacaaatgattgaaagtggtcaagaagacacaactgattactctatccataataaatctcaaatcgttcaacaaggtaatgatattgctattatcggagtaagtaatctgcttccattagccttaaaaacagctcaaaaatacaaagaggataccggtaaaaatatcactgtaataaatccaaaatttctaacaggtttagatgaagaattactaaatgacttgactaataatcatcgtcttattattactttagaagatggtgaattagaaggtggatatgggcacagaataagcagtttctacggtatgacagagatgaaagtcaagaattatggtatctccaaggcctttcatactgattttaatgctgatgaattattagctcaacatggtatatccgttgatcaattagtgacttatatgaaaaatagctaaaaactatatattattgttttatatataattctcattagtatacaataaaattaataatgtatttaaaaaaggctgtaacgtctaaagtgaactgcaacctgtcaagtagacaattgaaaaaatataaaatttttcctgccggtagattatctactggcagtttttatgcgatttgcaaataaattttatgtttttcgattctgatataataatggaattctgttatatctgtgagccgtttctcatttagtgcatcggtagtaaactctcgattaagtaaatttttagctatatattgaggatttacagcctgtcctgtacatccattagtagagtatttaatagttgatttgatattaagtagtacgtagtactcgtttatcattaacatcaatgtcatgataagattctagatcatctctaattcttcattatcctctatctggtgactctgtatggagcttttcaatctcatcagtaatccgtctgtttttttgttcgttttcagagctttctctgtacaacctccaaatgcagtttttcttccttttgtcataatagtgtgttctcctatttcagatgattttaactcttcatgattattatacttctttatccagagttgtaacttcaatcttggacaaattccgtattttttacaaatatcatccaaggaaccacgaccatctaaataatctaaaacagcttgctgacaccaaacatagatacaattcgattttggctttcttttccatctagatacaaatttacagcatataccttatcctcaatggatatttttcttttagacataaaatatgcttcctcctaagtgacaagtttttattatttcacttgtctccccagaaagaagcatatcaattttaatgcgttacagtctcttttatttataactatttaacaacaatattgacaattttattttttacaacaatcacttttacaatatttttaccctcagtatgagctttaacattttcttgttcaaacgcaatttccttcacagcttcatcatcagtatctttagtcacttgaatcttggctctaagtttcccgttaacttgaacacccatttcaactgtctcgctcactaacatattttcatcatatgttggccaagtttcatatgcaatcgaactatcatgtcccaacatttgccacatttcttcacaaatatgaggagcaatgcaagaaagcattttgataaaattaaatgcatactctttatatactgtctctgctttatagcattcattaatgaagatcatcatttgtgaaatagcagtattaaatcctaatgtttcaaaatcatctgtaacctttttaactgtttgatgatatacacggtcaagactatgatcattttcatcacttaatttatcttgttcgataaataaacgatatacccgatctaaccatttacgtgaaccatctaatccatttgttgaccaaggaagagcagcttccaatggtcccataaacatctcatataatcttaatgaatctgcaccatgagaagcaacaatatcatcaggattaacaacattaccacgtgatttagacattttttcattattatctccaagaatcattccttgatggaataatctttgccatggctctttacatttcactactccagcatcatacaatactttatgccaaaaacgagaatatagtaagtgtaatacagcatgctcagcaccacctacatacaaatcaacaggcaaccacttttctaacaatttaggatcacaaataacttcactattatgtggatcaatatagcgaatatagtaccagcaagatcctgcccattgaggcattgtattagtttcacgacgacctttttgaccatcaatctctacttccaaccaatcttcacagttagctaatggtgattcaccactatcatggggttgaaaattcttagtagctggcaattctaatggtaattcttcaaccggaacggttctcattgttccatcttccatatgtacgattggaattggctcaccccaataacgttgacgagaaaataaccagtctcttaacttataagaaattttcttttctccacacttatgctcttctaaccaggcaatcatcttatcaatcgcttcttgttttcctagtccatctaaccattgagaattaatatgtaatccatcttcagtataagcggcttcttcaatatttccgccttctaaaacaggtatgatctcaattccaaactttttagcaaattcccaatcgcgatcatcatgtgctggtactgccataattgcaccagttccataacttgctagtacataatcagaaatccagataggaattttcttaccattaacaggattaattgcatacgctcctgtaaaaacacctgttttatctttgtttagttcagttctttctaaatctgatttacttgcacaaatttctttataagcttcaatagcttctttttgttccaatgtagtaatttcagctacatatggatgctcaggtgccataacacaataagttgcaccaaataaagtgtcgcaacgagttgtaaagactgtaaatattttatctgttccatcaatcctaaaatcaacattagctccaactgattttccaatccaatttcgctgcatttgttttgttgcttcaggccaatcaagatcatctaaatcttcaagcaatctttcagcatattcagtaatttttaaaacccattgccgcatcggcttacggataaccggatatcccccacgttcactttttccatcaataacttcttcatttgctaaaacagctttaagttctggacaccagtttacaggaatttcatctacataagcaagaccggcatcataaagttttgtaaaaatccattgtgtccatttataatattcaggatcactagttgcgatttctctatcccaatcatatgagaaacctaaagatttaatttgtcccttaaatacctcaatattctttttagtaaattcagctggatgatgtcctgtttgaatagcaaactgctctgcaggaagtccaaatgaatcaaatcccattggatgtaaaacattgtatccttgcattcttttcattcttgaaacaatatctgttgcagtatacccttctggatgccctacatgtaaaccattccctgacggatatggaaacatatccacacaataatattttggtttactatcatcgtagcagtctgttttaaatgttttatgctcatcccaatatttttgccatttcggctcgatttgtttgtgatcaaacggcattttataattcctccttaaaataaaaaaatcatcctatctaaggacgacttttaatcgcgttaccaccttagttccaagtctaaaagacctagccctcaaaactttaacgcagttaacgacaacgactacttaattccccgctgcatctcctaggtgagttcataacccgttttatcagtttccaccagccactgattctctataaaaaacgtcaattactactagtcctattcatcgactttcaaatactagaatattataacataaaaaggctgatatgcaacaaattttattactaataatttggttgttttaatgctttaataggatctaaccggcctgccaaaaaggcgggaatatagctactgcacaatccaaaacataatgctcctaaatagatagcaattactaactgataatcaatttgaataaacgctcctgataaatcaagctgcagctcattttcaacaagctgattaattaaattaactaattgataaaaaaatacataagagcagataaacgctccactaattaaagtaaaactttctaataaaactaaattcatgatctgtaatttactcgcacccatacatttaaaaataccgatatcttttgttttttctataacagacaaatataacacttccccaattaagaaacatgctgctactatagccaataaagaaaatagtaaaagaactctttgaatttgtaacataaatgtatctattctttcattaatattttctcctgcaactttaaattcaaattgactatactgatcttctaaatccattaaaagatcatcaagatccgctttgctatttaaattgatcatagctaattgaaacaataatcgtttcttatcaatcgcaaaagcttggctaatatgatcgagattagctaattcattaatatagattgtgtcaaaagcagttacatctttccctattccaacaacagtgagtgagactcctttaatttgatcgtcctttaaataatatccatataattgttgattcaataatttttgataatcaggattaagatgtgttgccgttgtttttgataaaactatttcattactattttttgtttcacgtcctatttccaaattcctactttttattggtttagtcatatcactgatatagattgttttttcaacttcataatcactttgcagtgatactcccataaattcataatcggctggttccccatagataaattcattcatatctaaatttgataatgaaaataactcatgataactaagtaattttttatgtacattctgaatcgaaattagttgatttggaaatatagaatcaagctgtctttttatttgggtttgtaatgatccactcagtgtaaaggtaatcataatacaaatcaaagctactgtaataccagatgatatttttaaatttctacccaaattagcacgatattgtaacaatgccagttgatataattttaatggtgaatgctgtttgactaaacgcgaataaaaatgattatttttatcccggcgatacttcccaatcaattgtccattttgcatagaaaagcattgatcagcatattgataagctaattgctcattgtgcgttataacaatgacaagtcgttccttagcttctgcatgtaataattcaaaaaccatctttgcatttttatcatctagagaacctgttggctcatcacacaataaaatatcaacatttttaatcatcgcccgaagtaatgcaacccgttgtttttgtccaccagataagattttgaccctttttttattcagttttcggagttctaatttttcttcttgatcttcaactgctcttttatatgaaattttagtaaaaaattttgctaacaaataattttctttgacatttagccaattaattaaattgaaatcctgaaaaataaaaccaatatgcctacgacaatactttttaatttttcgaatatcttgatgatcaaataatatttctccttcataatcttgatctattccaccaattagatttaataatgttgtttttccgcatccagaatttcctactattatgatcaatcccgtacttggtaatattatgtttaaatttttaataatagtttcatcatatcttttagttaaatttttaatttccagcattttagttctcctttaacaatatgctaatatccattctgtttattttaagactagcttgtaaccctgctaaataacatgcaattatataaataacaatcaacactacatataaatcatattttgtaaaaatatatttcggtaagacaaacaaccttggaatgttaaataaataatcacttaaatcaaatagctcaattaatcttaatacgcccattgctaagattgctcccgcacttccaatcagccctcctatcaaaattgcttcacgacaaaataaattaattgctttacctttaccaagaccattagccaataaaagactagtatctctttttcgttcaataaaaattgttttaagaataactgaaattaaaattaatgaaatagcaaaactaattacaataaataagaaaatcacaaatctagtgatatcaaaaattgatcgatagttgtcaatataatcaccgtgtagattaatcagcaaataatctttttgatattcttttatcacagcatctacttgatcactatgaaatattaaaactgttttatccaggcaatcatcatttaactcttcttctaaatactgttgttctaaataaagattagtccctatattaatatgatcattaatgattccactaatagtaaattcatattcatcatcattaatttcaaaattaattctctcacctatttttaatttatacttctttgccgttgtctgattaattaatatttgattctcttttgaaggatatttcccagaaatataatctaactttttagttttaaatatctgatatacctcaacgtctaactcttcatcataactgcttaaaattccattactaaatactaatttgtaagcaacatttgctattttattattcttctcaaattttttaatttctttgcgttcaaagatattattaatataatcattttttgaaacttcaataactctttttaatgggtcttcttcaaattttttttctaaatattgccatccaccattaaaagcacttaataataaaacaaaagctagaataataaatatttgtgatacaaacatcattattatctttttaaattgatatttgagttgccttttacaataaaaaagcagtcgacctggctgcttttttatgattattggtgaatatttatgatatcgttcattactaaaattataataattcttttttttatcaagatctacaatcatttttgtatattgtttaattaatcgagaattatgcgaaataacaatcactaaatgctccttggcatacctttttaaaagtctcatcacttcaatacttaatttatcatttaatgctccagttggttcatctgctaaaagaattggtgtattacacaagaaagctcgaaccaatccaattcgctgcttttgaccacccgatagttcatcgggatatctttccaacaattcaactacttttaaagttcgacaatattcctccaattgaccagacacttgctttaaatcaataccttttatttttgtaattaagattaaattctcttttattgttaaagcattgactaaattataaaattggtaaacataactaatataatcacgttgatacattctaatttgttgatagttgagcctatgcccatcaattaatacctgaccattgcatggacgctcaattcccgcaataatgtttaacaaagttgatttccctgtaccactttgaccaatgattcctatcatccctctacttggaaatttaattgttagatcatcaataacgcgttgtctcttttttccatacttataaaatttagtaatattaataagttgtaatgccataacgtcctccttatgttataatagcaatggtgataaaatgaacttatttaaatatagtgatgataataaacgctatcatacttttaattattatctgaaaaataaatatcaaagtaaagttgccaaagttagtttgaatgcgggctttacttgtccaaatcgcgacggtactaaaggcacgggcggctgtattttttgtagcagcactggttcaggtgattttgccggaaatatccaggattcattagaaatacaatttagtaatgttagtttgcttcttcaaaataaatggccaaattgtaaatatattgcttattttcaagccaatactaatacatacggcccattaaaaaaaatcaaagcttgtatcgagccatttatcaataaaaaaaatgtggttgcaatcagcatcgcaactcggccagactgcttggaaaccgatgttttaaattatttagcagaagttaataatcgctgcgatttatgggtcgaattaggtttacagaccattcacgatcaaacaggtgaactaatcaatcgtggccataattatcaagacttcctagacggcttgaataaattacgaaaattaaaaattaatgtctgtgtacatattatcaatggtctacctggtgaaacatatgaaatgatgcttgaaacagcaaaggcggttgggcagttggacattcaagccttaaagatccatatgctttatgtcattgaaaaaacaaaattacatcagttatatttacaacagccttttaaaatcctgagtcgtgacgaatatattgatttagttgtcaaacaattaagttacatcccagaaaatattgttattgaaagattaaccggagatggaaatatttcagatttagtcgctcccttatggtcaattcgtaaagtaactatcttaaatgatattgataaattaatggttgctaaagattattatcaaggttgtaaaataaaaaagcccatttagggctttttctattattcaattattaattactagtttcaattaaaccataatcaccatcattacgacgatatacgatactaattgaatcactttcaacatcacgataaacgaagaatgaatgaccaatcaattccatttgcatgattgcttcttccatatccattggtttaggggtaattgacttaacctttaccaagacatcttcttcagattcaacatcttcaattgaagataggttgaacgcaagtttattatcttttgatttacgacttagtctagttttgtactttctgatttgtccttctaatttgtcaacaactagatccatagcattatatagatcatcatctacgacctctgctcttaaaagtacatattcagtaggaatcgtaacttcaagtttttgtccataaggataaactcgacataaaacttttgcttcaacattgtcacttacgatgaaatacttatctaatttagatagtttttctgaaatctttgcttcgatagcctctgtgatttcaatgttttttcctcttactgagattttcataagaattcctcctttgtataaacatattatacaatatatatttgtaaaataacactcaaattattgataaaatttccctaaatttaacataaacaaaaaacactcgaataaatcgagcatttttatctataaatatttttttagaatttctactttatctaactcttcccatggaagattgttatccccacgaccaaagtgtccataagcagctgtttttagatacaatggttgacgtaaatctaacgttttaatgattcctcctggagttaaatcaaagttatctctgattgcttttaggattatatcatggtcaacatgttcagttccatacgtctcaataaaaattgaagtaggttctttaactccaatagcataagaaacctgaatttctaatttatcacaaagatttgccgcaacaatatttttagcaatataacgcaacatataggcagctgaacggtcaactttggatggatcctttccactaaaagccccaccaccatggcgagcagccccaccatatgtatcaacaataatctttcgcccagttaagccagtatcaccatgcggtcctccaataacaaagcgaccagttggattgatcagcactttataatcagtgtttaaattatattttcttacaactgcatccattatttcttctttaatataacgtttgaattcagtttcatcaaaatcaggatcgtgctgaatcgacattaaaatagtatcaattttaggagtactttcggtataatcaatcgttacttgagctttcatatcaggacgggctgacttaaattctccagtatcctttttttcagttgcataacgaaccaaatgatgagcaattgaaatcggcaaaggcatatacccttttgtttctttacaggcgtaaccaaacatgattccttgatcccccgctcctccaacttcatcatttgttcctaaagcaatatcaggagactgtaaatccattactacctgaaccttgcaagtccgataatcgattcctttatcgctatcatcatatccaatgtcctttaaaacatctcgagctacctgctcatagttaacttctgcagtagttgtgatttctccaccaataactaccagatcagtagtagcaaaaacttcacaggccacacgtgaattaggatcttcttttaagcacgcatcaaggatagcatcactaatttgatcacaaactttatcaggatgcccttttgaaactgattcagaggtaaataatactttttctttcatttttctttctccttctacaaataaaaaagcttcctaaagagaaagcatacatagttaggaagccttctctcattgttcaagtataaacttgctcagttaggcaccttctaatttaatatagggttgccactacatcatcgatcttcatctagtagttcttaataagagtcttttttatttatttgttctatttcttctttagttagtgacgttattacctcaataatatcgtcatcgagtccaatatctaataagatactggcaatcattttttgttgccttacattcttcatattatcaccttaacttagtttgcataaattaaaaaataatattccttaaaacaacaaatacataataatatatctaagacattattgcaagcaatttattagatactaatattttagcatggaatgaatctttttttgtctcaactttgttttaaattaatactcagttccttctaaaatattttgcactcctaaaactcctggtacttcttccattaagatttgctcaacaccatcctttaaagtttcatctaacattgaacaacccgcacaggcacctaacatcttcacataaacaatgccatctttaaaatctattaattcgatgtcaccaccatcacgatttaagtacggtcttaatttgttaattactttttctacttcttcaattgtacttgtattttccattgtccttcactcctttagcacttatctattttaccacaaaaaaattatttttaaataaatatacactttaattaagaaaattactaggataatatgattttaactaaaaaccataaaaatcacttagatgatctatattataatcgactaactgtcggatgaaaaacactgtaatgacggtgttgtaaaacaagatacttaataaagaccattactactaaatatcctatcttcatcactattaattcttcatcactattaattgtttaacttttttattttttttatataaaaaaatgactgtttttcttttgcaagaatatatcagctattacgggataaaaaatagtgcattattttttcattcttctttttattttgatataatatatccgggaaatgagtataagtcccaaaactctcatttctcaaacatgcaaaaggacatgtaacacagataaagagccccactaaactgaggttctttatctgtctgacaaatgttctaactacgtacatatatgctaaaattacaaagctagacacaatattttaatttaaatataaggattgatttctcactcataatgaagtcaatctttttaattatgttttgattttttgttcttaataacaaaaatatccctctatttcctactctgttctaatgattcatattcataaaatatttcattcttcataaaaaatcctctatgacttaattaccaaaacaaaactttactataataccttcgcttctatcaaattttagtctctctattaaatcattatactatctgaccactaccaaaattaacaaaaatttattgtaaaatattttttattagatatttcaatattacattttaacttcattaactattcagcaaaacgaaaagatagcgttttcaaattactatgttataataaaagaatgatatgtgtgatataaatgtgatatatcaggaggggtggttatgatgaacaataaaaatactgcaaagaaaatgtcgattaatgaaaatgctattttagaaaaatatttaaatactctggcaactccaattagtaaacacaaacctgataaaaaactctcatttatatgggcaaatgatgctttttataaaatgaccgggcatgaaaaaaaagattttaaaatgatttggcaggatttaaaaacatactacaaaccttatacagatgattttattattcttgaaaatcaattagcaaagttgcaagagcatcgtgatttacatcaagaatgtataatccgaattccttttagacatgatgaaataaaatggattaaattatctatttcactttctttcgaagtaataacaattgcatataacgatattagtaatttgatcaatacacagaatacactcatttcaactaaaaatgtatatatagataactttcaatggatgatggcagaaaatgccggaaatgtttatatcagtgatattgacacatatgaacttctatatttaaataaagttgcatgtgaaacgcttggtactagagctgaacaagcaatagggaaaaagtgttatgaaatcatacaaggtagaagttccccctgtcctttctgtacaaataaatatttaaaaaagaatcaaacttatgaatgggagttttataaccctttattaaaaagaaattttattatcaaggatcgtatgttgaattggcatggccactctgcccgtattgagctttcccatgacacttatagtactgaatataagctagcaaagaaagattaagaacgagaagcaattttaaaaaccatttctgccgcgatggtacgtgttgatgcaagggattattcttcaattctctggtgcaatgatatttttcttaaaatgattggttatacaaaagaacaatttaaaagtgaacgttatgagttaaaaagctatatgcaccctgaggacttaaaaagagccaagcagattgttcataaattaagaaattcaaaagagagcgttgtattcgagggacgagtctatacccgtaataaagaagaacgtatctggacactgacattatgctacgtagatgaaagggacagctgggatggtatcccttgtttttatagtatgggtctagatattacagatgaaagacaaaaaataaagacattacagcataaagcagaaaaagatgcattaactgggatatacaaccgctctgaaaccgaaaatcaaataaaaaactttattattgaacatcatgactctaagggagcactcttcatgattgacacagataattttaaacaaatcaatgatacattgggacatattgctggagatatggtattaggtgaaatggcaacggctatgaaaaagaaagtacgtgatagtgatgtcgttggtagaattggtggtgacgagtttattattttcatgaaaaatattactagccacttagatgcagaaaagaaagctgaagaactacaaaaaacatttgcccatctatttgacaaagagaaaagtaagattcaggtaacaagcagtattggtatcgctttatatccaaaagatggacataattttttggaattgtatgcaaatgctgataaagccctttaccaagccaaaatccaaggcaagaatacatatatcgtatataatgaaaaatcttgtaatcagcaaagtattaccgcatattcttcactaggtgcaactatcgattcacaacaatcttatagtgaaacatctgtttcattagcagattacgcctttcgtattctatttcaaaacaaagatttaaaaacagctattaatctgattcttgaaattactggaaaacgctatgacgtaagccgtgcttatattttcgaaaccatgacagacaaagaacattgctccaatacatatgaatggtgtaatgaagggatcaccgctgtaaaagaacaactacaaaatatttcttatcatgatatggatgaatatgaaagagtattcgatgaaaattctatcttctactgtcatgatgtcacgtcattaagcaaaaaacaaagacaactgtttgaagcccaaggaattcattctacactacagtgtgcgtattatgagcaggaaatgattgccggtttcgttggctttgatgaatgtacaggaaaacgaatatggacaaaagaagagcttagaatacttactctcatatcgcaaattatatcaatctttctaaagcataaaggattaagtgaccaagtatcaaaattgtaatctagttattgttttagactactaataaataaaatatatcagtaatttaaagatatttagaaaataatcttatatacacaaataggctggacaataattccagcctatttatattcattaattctctaatcgtcttttaaaactagtaaagccatcttacttctaccagcaaatcattcatttccttttcacataattttagaataactattcttctactacattctttaaattgttattcctggttctagatggcgtaatactttattcttagcttaaatttaattttaacaaccttaaaaatgtattcttttacttaataaaaaaatatactaaatttattgaatctattgccttatcaatgatttttgtattatttataaaaaatgaaataattttatttattttgtgctataatatccacgcagggagtgattattaaatgagccaaaagattaaacgcggtgatatcattgatgtcaaaattactggtatccagccatatggagcttttgccagtttaccagataattcaacaggattaatacatatttccgaaatatctgataaattcgttaaaagcatcgatagttttgttaaggtgggtgaatcaatcaaagtaaaagttattgattttgatcaggaaactaaccatgctaaacttagcttgaaagccattgataatcgttatcgtagacgcaataaacgtgtttactataagaatcctagacgattaatcgttgaaacgcctaatggtttcaaaccattagctcttgccatggaaaaatggcttaaacaaggaatcacggaggaaagttaaaatgattacattagatttatctaaagctaaattaagcgaggatttagaatcatacaaggacaaagtaaaagaaatccatgatatgattcacaacaaaactggagctggtaatgattttcttgggtgggttgaattacctgaaaattatgataaagctgaagttgaattaattaaagaaacagctgctagtctaagagaaaaaacagatgtgttactagtttgtggtattgggggatcttacttaggtgcacgtgcagcaattgaagcaatcaacggattatatccaactaatgatgttgaaatcatttatgtaggaaatactttttcatcaaattatattaaacaagtagctgattatattaaagataaggattttgctatcaatgtaatttctaaatcaggtacaactacagaaacttctatcgcatttagaattttcaaagaaatgtgcgaaactaaatacggtaaagttggagctaaagaaagaatcgttgctacaacagataaggctaaaggtgcattaaaaactttggctactgaagagggatatacgacatttgtaattcctgatgatgttggtggccgttattcagttttaacaccagtaggattattcccaatcgcaatggctggaattgatgtagatgcaatgttaaaaggtgctaaagatgcgatggaaaaatacggtaatgctgatcttgatcaaaatgatgcttataaatatggtgttgctcgccagattttacacaaagccggataccctgctgaaatgtttgtaacttacgaattacaactagctatggtagctgaatggtggaaacaactttacggtgaatcagaaggtaaagaaggtaaaggtatcttacctactagtgctactttctcaactgatttacattctttaggacaatttatccaagaaggtacaaaagttctttatgaaacaatcatgcaaattaaagaaccagctggagatatcactattcctagtgataaagatgatttagatggtcttaattatttagcaggtaaatctgtagactatgtaaataaaaaagcttgtgaaggaactgttgatgctcatgttaatactggtaatgtacctaacattttgattactttagataaaatggatgcttatggttttggttacatggtatatttctttgaaatgtcatgtgctatgtctgtatatttacttggtgttaacccatttaatcaaccaggtgttgaagtgtacaaagcaaacatgtttaaattacttggtaaaccaggctattaattattatgacgatctttgatcgtcttttcatttgcataaatatttaaaatatggccaaaatgtaaaagaagtgcttattatattaaactaattataaaaaaattaatttattataattttttttattgactaattgaaaagtaaatgataatatatttaggcaccaaggcactggaggtttagctcagttgggagagcatctgccttacaagcagagggtcagcggttcgagcccgttaacctccaccatttaaaataaaataggccggcttagctcaattggtagagcaactgacttgtaatcagtaggttgagggttcaagtcctttagccggcaccatgatggaggagtagcgaagtggctaaacgcggctgactgtaactcagttcctttggttcggtggttcgaatccgccctcctccaccattcattggggtatagccaagcggtaaggcaacagactttgactctgtcatctccctggttcgaatccaggtaccccagccattaataatgacccgctagctcagctggtagagcatctgacttttaatcagagggtcaggcgttcgaatcgcctgcgggtcaccatttaaaaatagtgctatcatattaattcattaaaattgcgggtgtagttcaatggtagaacttcagccttccaagctgactacgtgggttcgattcccatcacccgctccattagtaaattgctcacactaagtgtgggttttttattttattaaaaattacctggcttttataaccaggcaattttgggtaaacgagtatatttatttaacatttgccacgcaattactaaagacgctttttgattatctatattttgatacatattcaaaagtgttttttttatttgtgcatcattacaatcatcattgattgccagctgcataaattcacttggaaacaataatcgtgaatagagataaattatttcatctactgttagagcgctaatctgaatgtactcttctaactgttcaactgaaatcaaattatttttatagctactggctaaatccttgactcttgaagctatgactaaattagctggacagcaaagcatctcatagttatcgatcatattaaagtgttctatccccgcaactagcttagtttctttaatttcatttaacacgctaattgcggcttctccaagaccttgatagtaatatgacagcactacaaaatgttcaaaatgactgattcttgaagcatagttaccaatcttgcactttgcttcatcaagaattgcacaccagctttctttaatttttaaaacttcaacctgaatatctaaaggtcgcaaagaatattgtaaaaacatttcaaaatgataatcttcgatttgataagtatacaatatatagtccattgagataggacgattaaaacagttattaacaaccatgaaaccatttagtcctaatgcatttacatagtatggatagtcattagtaaaattattaaccttgcataaataataaaaattaccttgaaaactaaagaaatcactttcttgttctagatagatctgataaaaacgttgtaaaatttctaattctgataccaattaggcacctccccttcaataatttccatcactaatggatagtcatagtctttattaaactcctcgttataaaatggtaataataccatcatcttaattttaataaccaatttcaaagaaaccataacatgattcacaccgtagcttttaacatctttttcgactgagcaagtaatcgcagatatagtttcatatttaagttttattttaggtccaacacctgctaagaaaggattttgtgttaatgctccaatgggaatagaagcgattaccccaccttcgtcactcatcttttgaaatcgacgttgataaaaagaattatctgtttttttatatgttccttcttcaatcgctacaaacaattcatctaatttattaaccattttagctccaatacttgaagcataactcgtattaaaattaattgtcgcaatttcatcaccattacgattgatcttgatcagttcctgatggtctaatgtaactggaaaaggggtattgttgattaccatctgacaaaaccgatttatttctttgtctgcaatcttctttaatgcaggagtaatattaacactaagaacttgaataacaattgctaaaataatggtaattacaataaatatatatcgttttttcattaaaccaccaatatattatatttagttttgtttctaattatacctcgaagaaaccatcttatatatttggataataatacttggaaatgctgcagaaacaaaaattattgctaattgttttagtgatagttcactaattgaaaaaagtgaatgaaaattaggagaaattagaatccatgttaataatgatactccaattacaaaagctccaacactataataatttacaggaattttatatagtggcaagttacttcgacagttaaatccatgcaatagtcgcgccaaacaaagtgttccaaatgccattgatgaagcagtcaattcatcactgcgtaaaccaataaaataagctaacattgtgaaaatacaaattattatcccttcaaaactcacttgtaaaattgtctctttattaagtaatgaatcgcccgatccccgtggcttttgctttagaatttcatcactccccttttccatcccaatcgcaatggccggtaaagagtctgtaattaagttaataaatagtaaatgaaccggcaaaaaaggagttggtaaaattgcaaatgatgtaactaaaacacaaattattgcggataaattcccagataaaagatagataattgaatttttaatatttgtatatacatttcggccagtaatgattgctttaacgatagttgcaaagttatcatctgtcagaatcatactagctgcatccttagaaacttcactccccgtaattcccatcgctaccccaatatcactttgtttcaaagccggagcatcattaacaccatcaccggtcattgcaacaattgctccacgtgcttgccaagcttgaacaattctaattttatgttctggtgcaactcgcgcataaacagatacatgtggcaagtaattccgcaattgctgatcagtaagtttatctaactgagttccctctaaacatttatcaccttgcttaaaaataccaattttctttgcaatactgcacgcagttacaacatggtcaccagttatcatgattggtttaatccctgctaaaatgcaatctttgaccgcctgagcgctttcaatgcgaggaggatcaattaaagatactagaccaacaaaaactaaatcattttcatcccttttttctaatgtattacgataaaactctttatacgcaaatcctaatacacgctttccctggcgcgccaaagcatcattttgttccataatacgctgcttatctttattagtaaaaatttctttatatccatctattaatattcgattacatcgttttaataaaacatctggggctcctttagtgtatagatgattctttgaagtaacactcatcagctttcgggtggaatcaaacggcaattcctgttgacgtttagtctgcaatcgatatgcgtttttataattataatcttgatataattccagtaaggcaatctctgttggatcaccaatactctgtgctttagaaatagtagcattattacataaaacaaaagcctttaataagatattatgacaatattcgtgatgatttaaacgatttgcttgtattaacatccgatttgtatatatatcgactgctgtcattttattttgggttaatgttcctgttttatctgaacatatcactgaaacacaaccaaggctttccacagcatttaaatttttaataattgcattttctttagccattttttgagttgaaatcgacaaaacaatagttacaattgatcccaatgcctcaggaatcgctgcaacagctaatgctactgcaatcatcaaagcatcgagcaattgttcttttgcgataaagacatccataaacaaaacaataatacagattgaaataatgccaattgacaattttactgaaaattcatctaacgtcttttgtaatggcgtacgacgctgtttagttgcattcaacatctcagcaatctttcctaactgcgttttcattccaatgtttgtaacaatatattgccctgttccatttgtaactaagcttcctgaaaaaaccatatttgtcatatctccaatagtacattgatgatttattgcaactaactgcttttcgacactatttgactcacctgtcaatgcactttcattaacttgaagattattcgcttcttttaagcgtccatcaccagcaattacatctccagcctggataaataccaaatcacctactgtcaattcgtttgatttaatttcaactaatttaccttcacgcaacacctttatttttggcatagataatttttttaaactatccaaagatttctgtgcttttacagtttgaaatgttcctagcaatgcatttaaagtaattacaaccaagatgaccaatgtactttcaaattctccgctaatagctgaaataatacccgcacaaatcaagattattactaataaatctttaaactgatcaaataagattccccaaacactttgacgcttttcaccaataatttcatttcttccatatcgtgtttgacgcttaattacatctttttgacttaatccattatcactgactcctagtgcttgctggacctctttaaacgatttttgatatgcttccatattatcctcctgtaacccaattcattaatattaactatacaaaaaaggacataaaaaaaatgttaaaatttaattactttgctaaataattaaatcttaacattattactattaacgtttctttaaaacagctttaaacattccaataaaaatatcaccagaaataaagtatgcgtagccaagcgcaataacaatatttaatatccataaaattttatctcccgaccatgctaaagacatactaattataaaaattacgattgtcaacactgttagacgtttatttatttttaaacgtacatagcgccgattcaaatcaaagaaccgatatcccgctaaaaataaattcgcagccaatgttgaaagaacagctgcctgtactccaataatattaatcaaacctaaattgatgataatattgattatagctgcaatagtcgttgttaccgacatatttttagcacttttaacagctacataaatacttccaaaaaattgtgagaagcaataaaaatatgtagctaaaattaaggttggggtataatcgaaagcactatataattctttattacggcataaaattccaaagatgatcggtgatccagccactaataaaactgaacctgctgagacaatgcaaaacaacatccgaaacatcctattataatacctgccactatcaggatcatttacactccttgttgccgaatctgtccaagctaaattaaaggccggatataagatattaacaatcgaaggtattttattagccaaggcataaacaccatttggccctgcccctagaaaaattgaaataatccatcgatcagacaattgattaatataccatgataccatattaggtacaaacggtaatgcatagccaagcattttaagagcatattcgctactaaaatatttaaaattaaaaaatttaaaaatattacatacgcatagtacataaataaagccgactacatcagcagctactaatgctattaaaaccccaatataccctgtctttagccacaataaacaaactgagacaacaacaaagttgactattacaactaacgccgccaaaatagagtactctttatatttggaaaaagcccttaaaacaaacctagaagttgttgcaataatctcaatccatatatatccaataatcaatagcttaaaactgccttcaaacatgctgattggcacaaacagacaaataatcgcagcaatcaccataagtccaaaaatcattacatatccgttagtaatgacacgccgttgttctttttcacttttagcatcaacaagaaatctaaatagagcctgttcaatttgcaacgtacataaaggtacaataaatgaaagaatcgtcgttgtaactaaatctaattgcccatactgcgcatcagtagttgcactagtaataattggcgtagtcaataaattaataatccgaggcagaaaagtccccaacgccataattaacgtatttttaactaatgttttctctcttgacataatttcaccctactttatattccccattataacaaaaccgtgattatttttcattaataatctttttaatcggcaaatcaaatggttctactggtaaatttgcaacttcttggaaactaaatgccaagccaattacattaccacaataatcacttaaatagcggtcataataaccaccgccataacctaatcgattaccactttgatcgtagccaaccattggtacaattagtaaatcaagattatctttagtaacaggatgactattattaggttctaaaattccaaaattacttgtctttaattcattgattgaattaatttgataaaaatccatctgtttaccactaatttttggaacacagacaattttattattaattatttccttaatcaaactgattgtttctacttcatgtctaaaagaaacatagattccaattgctcttgcctcaataaattcaggttgctgttttaatttagaaacaataaaattagatttagatgcataagtttcgctatctaaatctaatcttgcttgaatcaattgtttccgtaatacttttttatccaataccctgatccccaaaatccaatttaattaattgatttagttcaacagcatattccattggtaattcgcgagcaaacggctcaatgaaccccattacaatcatttccattgcttctttttttgttaaaccacgagacattaaatagaaaagctgttcttcagaaatttttgagacagtcgcctcatgctcaataatagaatcattatttcgcatccaattaaccggaactgtatcactagttgaaatgtcatctaaaatcaacgtatcacattcaaccttgctttttgaattataagctttagcaccatgctgtaccattccccggtaattgacttttccaccgcggcgagaaactgatttagaaacaatactacttgatgtattaggcgctaagtgaatcatctttgaacctgaatccataatctgattctcaccagctacagcaatagtaatgcaagaaccttttgctccctcttccatcaacacacaagttggatacttcatagttacagcactaccaatatttccatcgacccattccattgacccatttttaaatacttttgctcgctgagttactaaattcaaaatgttgttagaccagttttgaatcgttgtataacggcattttgctccttcacccacaataatttcaacaactccagcatgaagagaatcacgagaataacttggtgcagtacacccttcaacatagtggatatccgctcctttatcaacaatgattaaagttctttcaaattgtgccatttgctcagaattgattctgaaataagattgtagtggcttatctaatttcactcctggcggtacataaatgaaagatcccccagaccaaacagctccatttaaagctgaaaatttattgtcattataaggaataacagtatcaaaatattttctaaatatttccgggtactcacgtaaaccactatcgatatctaggaaaataacacctttttcagtaacttcctttaacatgttatgataaacaacttctgattcatactgagtactaactcccgataaatacttttgttctgcttcaggaatacctaatttattaaatgtttgtttaattgtttcaggtacttcttcccatttattcgtttgtttatcactaggacgaacgtaataagtatattcatcaaaatcaatacggtctaaattaacgccccaagttggcataggcttttccataaagcagcgataagattttagacgatattcaagcatccattctggttcattcttaatttttgatatttcagtaacaatttcttcatttattcctttaggagtcttgaaaactgaaacatcaccatcattaaaaccataggcatattcctgatcaggaatttcattttttatatctgccatatgtttcctcctattctttatcgaggatctgtttgattcctgtccatcctaaagtagcacacttaatacgattagcctgtttatgagtattcataaacgcaattgcttcttccaaaatttcagggtcataatccttttcataaatcatattattgtaattttcaataataacattagcttcatcaattgttttaccaatcaataattcactcataattgacgtactagcagtacaaattgcacatgcttcgccatcaaaacggatatctttaataacaccatcttcaattaaggcttgcacatcaatatcgtcaatacaagtttctgaatccatatttactgactgataattatcatcatctactagtccatgattacgtggattttcatagtgatccataattatttgtcgtaacatcatactatccaaagaaggcatctaaaaagtcatctcctttcttacatacctcaataaatctgtcaatttcttcaaatgtattatagaaatagaatgatgctctaagagtttgactaacatctaaaaattcatcaagaatcttagcacaatgttgcccagctcttattgcaataccatatgtgttaaatagtgaagctccgtcctgactaaaaacacctttgatattaaaagcaatcgctccatgaccatttggattataaacttccaaattatctaattctaacatttttttaaccgcatattgacgtaattctaattcataatcacgaatattgtccatcccaatttctattaaatattcaattgcggcacctaaaccaatgacaccctcaatattaggtgttccagcctcaaacttagccggtgcattttttaatttaatccttccacagctcttatatcgggcattgcttccaccaccccaacgagttggttttgtttcttgtaataaatcatatttaccataaagaattcccaccccagttggtccgcacattttatgtccagaaaaaactagaaaatcaatatctaatgtttggacgtcaaccttttcatgaggaatactttgcgcaccatcaacacaaacgataataccgcgctcatgagcaatttgacaaatttctttaattggtccatcaaatccaagaacatttgaaacttgagctattgaaataatttttgttttatcactaattgcttttaaaacattagcaacagtaagacgtccttcatcatctaaatcaatatatttaaccgtacttcccactgtatcacagacttcaaaccatggtaaagtatttgaggcatgctcagcaacggttaaaagtatttcatcaccttcatctagatgcgtcatcccatagccaaatgctatcatatttagcccgtctgttgaaccatatgtataaactacttcttttcgatcgcaatttattaattttgcaactaaatcacgtgtcttttcgaactgtgtatcaacatcatgcgataagtcatagtcaccacgatgtgcattacccgaatagtttgtcaaataattacatacagcatcaattacacactgaggctttaaagttgtagcgccattatcaaaataaatcagtggttgaccatgcatcgtagcaccatttaacatgggaaaatcctgacgaattttttctacatctaacattaaatccccaccttttcttttaatgtttcgttaaacatctctcttaaatcagcattatctataaattccatgactggaataaaatatccataagttactaaatgcattgcatcttttttacttaaaccacgagattggagataatacaaatgatcctcatcaatcttaccgacactagcaccatgacttgcttttacatcatattcatcaatatataaatatggatttgccttggcattacatttctcatcaaaaacaataattttatttgtttgatgactgctagattgatgatttccttgtttaattgttccaatcccatcgataactaaattagatgcatccttaacaacaccataattatccataatcccggttgtatgtggtgcaaaatgcgttaacgaaaatgtcatatgcttcttttcctgtcctttagctaatgaagctaagcgcaccgtactattagcgttagaaccattcaaagcatgattaacattcatttcaatacttgaatctgataactcaacataagcgcatcttacattactatcacgctcaaccgatacattttcagttacttcaacagtcccgttgacactgctttgattatcgttatatcttaaaatattactattttgcaatacttcaatgtttttaactaaagatgctggaactttaaaatcataagtctcaattaattccagttgtcctttaatctttaggtcaaaacaatattttccttcttgatcaattagataaataatttgtaatgaggcagcatctttaacatcgattttaccatcattaatagcaattcctacattttctgggtgacattcaattgtaccattatgaaatactaaataatttttaatctcttttaactgtttcattatttagctttcattctttctttattggcacaactttcaagtaaaatcggtttcttttcatcagtagcgatttcaactcctaattcttttacccagtcatagccttcttgatcaattttttctactacttcaattccaccacttaaaataattttaccattaactaatacatgaacgtgacttggtggcaccaattcaaacaaccgttcatagtgagaaaccataatacatccaaaatcatctgatttcatagcgttaattgcttgtgatactatttttaacgcatcaacgtccaaacctgaatcaatttcatctaatagagcaaacttaggttgtaataatttcatttgtagaatctcattacgtttcttttctccaccagagaagccttcatttagataacgatgtgctaaattctcatccattttcaaatcagcaatatttttatccagtgcttttacaaatttaaataaagatactggtttttcttgatgtgcatttaatgcagctcttaaaaaatctgaagttgtaacacctggaatttcttgaggatactgcattcctaaaaagattcctgccctacttctttcatcaacactcatttctaaaacattttgatcatctatgtagatactaccttgagtaactatatatttaggatgccccatgataactgataataatgttgattttccattaccatttggccccataatcgcatgggtttcaccagtattaacaacaagatcgataccttttaagatttctttttctccaatactgacatgcaaattttctatttttaaagttgacataattaagcccctttctatccttactaattctactagataagttatcaaaaaacaaataaaatgataaattatagcaaaaatttttactattttccaatcaaaatctagcacaatttatattataaccacattgtgaccaaattatcgataattatcaagagatttgctctattataatattctaatcataacatccaattgctttttttagatgaaaattataaaactttatacattttaactatttttgatttttctaaaatagaaattcaattcaatttatattattagtaaattgtggtatatttatatgtaatgggggtgtaaaaatggaatttctaaaagcattatttaaaattatttcatcaaaaaaaatcacccatactttattaaatgtgatgatcgttttagtaatattactattaattattgccactggtgatttatggtatggggtgttatcagcgatctggctggtttctaaaccatttattgtcggatttacaattgcctttgttttaaatccactgataaattatattgaaaagtatgttactaaacgaagcattgccgtaacaatggtctacttagctgcttttgctattttaactttattaatttctttagctgtaccaatgatttatgaaagtatctctgaaatgttcccggctttttactcaggacttggtgaaattggtgtgtttgttaaggaaaatttcaattatgatatttcttctttaatgcgccatattcagaatattgtcaatgctttctttaaagattcagttgttttagatacaactatagatgttttaaatcaagttatgatcaatgtcactaattttttaatctacatcattctagcaatttatatgtctagtaattttaaaaatatccgtagtcatattcgtaatattacatatcgtattgataaaacattgccaatctatttacgtgaaattgattcttctttagtacaatatgttaaagctttctttattggagcaatcgctcaagcaattacaacaatgctgatgtatctagcaattggtcatcctaactggttaattcttgggtttgtttcaggagccagctccattattccatatgttggaccaatcgttgcgaattgtttaggattaattacttcgttaggaatgggaactactacaattgttattttatttattttgattttcattcaatcgacgattatgtcatatgtgattactccacgtatctattcatctagaattgatttgagtataatgtgggtactttttgggattctctctggttcttctctcttcggtatttggggaatggtaatcgctatgccactattagtaagtgctaaaataacttttcaagtttataaagaaaatcatcaaaatgaaaagcttatggaatgatacgcagcagcgtatcatttttgtttgaatttaaaagtaatttatattatagtatgtactgggtgataaaattggaaaaagtgaataataaaattacaaaaaaaataaaaagaatctttccgccatattttaaagaagagttatttaattgtataactcatggaattatggcatttatcatgttacttctaatcccagcttgtgctgtatatgcatatgttaaaggtggtcctatccaatcttttggagttagtgtttttacaatttgcatttttttaatgtttcttgtttcaactctatatcatgctatggatcatgacagtcctcataaacaggtattcagaatccttgatcatatctttatatattttgcaatcgctggaagttataccccagttgctctgtgtttaattaaaggatatcagggaatcatcatccttgttattcaatgggcaatggtaatagtaggaattttatataaatctatttcaataaaaagtttaccaaagctttcgctaactatctatctagttatgggatggacagccatcctatttatgccttcaatcattcaaaattctagtgctgcttttctctggctaattgttatcggtggtttaatgtattcaatcggagcatacttttatgcaaataaaaaaataccctacaaccatgtaatctggcatatatttatttcaatagcttctatcttacattttattgcaatagttttttatatttaaaaggatgtcttgacgacatccttttttaattagcacatattacaaatgattactaataaaatgaataaaactaagatcaatgtaaaagaattatcttggcatgccattgtaatcgcctcctttttattacatacaatagatacctacaataactagaataataaacaagacatagatgtttacattagtgcatttacagttattcatcaaatcccctcctaccacctacatattataaattatgttaaaataacaattggcaatgtgtttttgcctaatttattgaaattagatgcgataaatagtataattgtaacgttatggaaagataaggaggaaagatatgaaattaggtaaatgtgctgcggcactagtcgtgactagtttcttattaactggttgtcaaaacagctcgaaaacagttaaagaagatgggaaatatgtagttgcttctttaaacagtgggaaaaaagataaaaatatttttgcggatgatatttttaacgatgtaatatctactgccagtggaaaaagttcatactttaatgccgtgcttcaacaattaatggatcaaaaattcccaatcgatgaggatatggaaactgatgctaatgaaacagttgatcaaatccaaacttactatgaaaatcaatatggcgataatgctgaaactcaattacaaacagcgttaagttcaagtggatttaattcacttgatgaatatcgtgaaaacatggtgagagtctatcaaagatgcaactttttattagcttacgttgaaaagaactttgatgaagttttcgatgattattacactcaagcaagtccacgtgaggctagtcttattaaagtttcaatgactgatgttgaaaatccaacagctgatgaaacagcaaaattgagtgaagtcactgctttattaagctcaagtaaaagttttggagatatcgccaaagattactctgatgatacaaacactaacaagaataaaggaaaattaggtattgtagatactacaagtggtctttcacaaacatttggtagtgatgttgaaactaaaatattagcacttgccagtggtgaaactagtgaagccataaaaggtactgatggatattattttgtaaaagttactagtactgataaagatagtataaaaaaagaaataaaaaaagatttatctattgatactccattgattgcatatgataagtatatgagctatattgtttatcaatcttataatgttaaatacgatgataaaaatactgaaaaaataattaataatgtaattgatgaagctttaaaagaacgcgaaactagccgaggaggaacaaactaatgaagaaaaaaatatttcctttagcaatagttgcaactcttttggtcggatgtagttcttctagtgcaactacttatacttcagaaataaaagatggagataagactattgcaactgctgatgatgttaaaattagtaaaaatgatgtttaccattatttactaaaagaatatggaagttctgaagttctttcattagctttaacttatattgctgatcaagaactgacagataaggatgcagtgcaaactagaattaatgaaaaggttgcaagttttactgaaaacttaactacttcattagaagaatatgctaaacaatatggttatgaaactgaacaagaatatatcgatggtgttttaactttaggagtaaaacaaaccatgcttaaagaaaaatatattaaagataactatgatgacctggttaaagaatacaaagttaaatatttaaaaattattactttagacactgaatcagctgccttaagtttaattgataaagttaaagatggcagtgattttgacactttaatgactgaaaacaatggtactgatgctggtatggtcactactaaaacaagcagtgtcgactcaaaaattattaaaaaattagataaatttactaaagatggtatttataataaagtgattaagacatctgaatctaaatatgctgtagtttatgtttacaatacagataaaaaagatctaaaagatgaaattattactaatttagcttctgttagtgatatgtctacaaaaatggaaacatattatttaaagaaatacaattttgatgtatacgaatcagcaatcaaagatgaaattaaagaatcaaatgaagattatttcggataaggggtttccccttatcttttttctatgttagaataatattatggaggacttatagaaatggagaattgtatcttttgtaaaatcgctaataaagaaatacctggtaaaattgtatatgaagatgatttatgtctagcttttttagatttgagtcaaacaactaacggacatacattagttgttcctaaaacacactatcaaaatattttagatgttgataaagaagttttgagccatctaatcaaagtaacaaaaaagcttactaaccaaataatcactaatttagacgcaaaaggcgcgaatgtgcttaccaatgcaaatgaagtggctggtcaaactgttatgcattttcatatccatattattccaagatataatgaaacagatcaaatcaaaatcgactttactgatcgtagtcaagaagttgatttagataatatttttaataaaataaacagcttataaaacttagatattttcgctaaattaaagtaatttactcttgtatattacttatttagcgtttttttatcaaaatcattttaaattgattatcctatctgtaattataaaagttaaaaaatgacgatacttaatctaaatgttataatttatttaaaattattgactttggaggaagttaaaactatgaagtattttttaatcgaaggtatcgttactcatcctgaacgaatgacaaatgaaatgatgcaagagcatcaaaaatatacaaatcttttaatgaaagcggggaaagtactcttttcgtcattaaaaagcgatatgagttcttcaataactgtaataaaatctagaaatgaaactgaaatacaagaattttataaacatgaaccactttttaataataatgtgttaagttatcacatttccgaattgcaaatacattatcatacttctgaaactgctaattggttttaaagtgatcgtaaaaattcttaaatttaaataattaaattgttatttatacttctatttcattaatagggtaaaggaataaatttgataatttattctcccattgaaccgtacgtacgtgtctcgtatacggctctacatttatatcactcttaagataataatctaggtgatagactaaacctggtctatcacctttctttatgcttagaacttttagcgatattataaaattgactatattcattccacttctcctataccagcctaaccttgtgtttgcacacttataaatgtcatcttcactaaatctacatttacatgctttgtttaatttcattagatttctatatattgcctttggcttcttccacctcttgcacagtcattttgtctattccaggtactcctttattttgtttgaccttttcgatagtcattttcaaattctctttacttttaccatctaggattacgtttcccagttctaggctatcctcactttcgaactatccaaatattgcttatagtgatttgcactttataaacgtttcagtccttcatcatttctgactactatgacttcatcagacttcttgtgataaatctttttctatcgatggtatcattactgtttttaacagtttactggacttcatcgtccacaaggtctcccgaggtaaggcatacatctttttttatcttcacaggtttttgatttactgtcttggtttgttctgcaaccttatctcccattcagcctcatcaaatttcttttcgtaatctcgaatatttcgctacaccacttccatcacccatagcatcactactaatggtttgtggttcactactcttagcggtaaatacccgtggtgggactttcaccggctaaatgtatgccatgctcggcacacagaaaaagagtaattctgtcaaatgatagaattactctttttaataagttttacaatcttaatttaattcatttttggtttataaaaggctctattttctaaagcaaaaactcgttttgaaaaaccacctggttctactgtctctaaagctttatctagcatattgatccgagcatccatattatcaattaaataaattacctctgcttctttgatttgtggtagtattggtgaaccaaattcgttttttccatgatgagataaaattatatgttgtaacagcgtaacttcttcaccctcaatattcattttatcagccatttctttgatcattgcctgagagattgatatatgacccaataatttaccctcgattgtatattcaggtacaactggaccacttagttctactgttttacctaaatcatgtaatgtaattcccgcaaataacaaatctctatttaatgatggatataatcgagccaaagcatcagctatccttaacatgctgcaagtatgatatgctaatccagatacatactcatgatgatttttactagcagcaggataaattgttaatttttcaacatgttcgttgaataatgctttaactaactgatttaacttaagattgttaattcgctcaataaaagtataaatctcctttacaagctcttctcctgtttgtggcgcactttttagaaatttaacttgttcttgaggttcagttgaagcaacaacaattttgattatcttcatttggcgatcttcattatatttgattacatcaccttttacttgtacaacacaacccataactaacttttctacttgctcattagttgcattccacaatttagcatcgattgtcccagtagcatcttgtaaagtaatactaagataggtagaacgattggccccatttgtttttccaacaacaacacggttaatcagtgcctcaattactacgccttcatcaccaggttttaattcatttattttattcatcatccaaggctccttctctatttaataattctttaatatgctcataattgtaaccttttcttaaaagagtatcaatgattttttcttttaaatgagtaccttgatatctttttgaatactttttcttttgtcttgagaattctttttccaaagcttcttgttcttgctgatcatcaaactcaaaatcaaaatcactaagtgctcgttcaattgtttcagaagtaaagccttttatataaagtttatctcgaattttcttcaccattgctttataagaaaaactagtattacgactataaatggattcaattaatgtggtggcagcattatactcatcgtcatcatcatcaatctcttctaaacatcgatcaataatttgactatcaattccataactccgtaaattataaatagctttatttaagccaattccaagtcgtgtacagcgttttaaataatttaaggtatatgcttcatcatttattaaattcttctcttgaagtaactctagcgttgcatctaactgtgtatcatcataatcaccactatccattaacttctttttcatttgattataagtataatcttttactgtgagtaattttaacgctttattataggcccgagaaacttgttcaaaatcttttaaaacatcaaataactctttatcaataactttatttggctctaattgataagctttaattaatttatcatttacctcaacaataatctcactttcatcaaatagaaaaacaacttcatttatccctcttttaaccggatatatcgacttgaccgtatatgaatagtgtttcgaattaattgcttgctgataaacagcaattaccttttcataaaatacttcactactaaacttcattgcacttaagtatgcggcttctgccattttagaataatcatgattaattaattttaataggatttccactagttccgatgtttctttaaaaaagtacccatttacaccgtcatcgataacatcctccaaatttttatcatagcgtgcaacagcaggtattccacttgccatcgcctcaatataagtcaatccttgagtttcagttattgaagcagaaacaaatacatttgataaatgataataacttggtacctcattactaggcttagggccggtaaaaatcacataattgctgatatgatcatcttttactaattctttcaattcctctaactgtggtcctccaccgacaatcaagcaaagtacattatcattttctttaataacttccttcattgcatcaattaatacttcaatacttttttctttcgcaattcgtcctaaaaaagttacaataaactgatctttaattccatatttgtctttaatttgctcaatcaattcagtatttttatttttaggatcaaatttttctagttctaatcctgtaggaataatatggacgtctttatttaaaccatataattctaatgcttctttagtctttaaagaaggtacgattaattcagtacttttatcaccataaaatttactaatacgtgtaattgcctttttgatcaaaccatcaatagctccagaatttacaggattaacataatgagaataatctgcccacatcgtatgatacgtatagacaacaggaatattaagagtttctcctacgattcttccaaatattcctaccccaaattcagtttgaacgtggataacttcaatgttcattcccttaatttcacgcattcctttgaaggaataaatattacaagcccggtaaccatacagggcttgtatttccaatccaggaactcttaagatattatcatgaggatcatccatataatcactatcactaggtaactcgctagtaacaacaactacatcatgtccatgttttactaattcatctttcaatattttagttgatgtcgctaccccattaatatcagggatatatgtatctgaaaaaattgctattctcattactttactccgatctatttatttctcgattagttgcaaaaatgataccaccaataattagtcctaaatagtaggttacaaagcgccatactaataatgttgttggcgtaccaacagcccctaaaatagggctaaataacatataataaactccttcgctcccgccacttgctccaggaatcggaacaaaggcagtaatcatataaacaaatgaacaaataccaataaaatcgaatatttggataaatgaaacattaaggtttaatgcttttgctgcaaagaagggaatactatacataattaataatttaaacaaattaattaatgatgattttatcaatacattcttattttttaataacacgtttaactctgttctaaagttttcaagtgaacgtgcaatcttaatagaagtatcttcatagttttttacaattcttattttacttaacgcttttacaatattattacaaataaaatcttgtaatcgctttgatttagcacctaaaaatagtccagtaataacaaagaaattaatcaagaagcctaaaattgctaatgaaaaaaattctgaatacattgaactataagcctgataacggaaaatcatcactactgcagtaaataaaactagtactgactggtaaacaataaaagccatcaataaaatactagcagagttagttggggcaattccctgcttattaaaaatatagacttgtgcaaattgacccccactagaaaagggggtaaccccattaaaaaaagttcctgaaatcgaatttacaaacccttgcttataactataatcttttttatataacttaccaaaagtatatagattaattccatctaataaaaaatatatagacattaatgcaaaggaaataacaatccataaaggcgaggccgttgttaatgctcttaaagaagcatgtaaatcatctttcattgtaaaataaattacagttgcccctaaaacaagaattaaaataatgttaaggaaatattttttattagatttcttatccataagctttcctcatattagaggttcagcgtttcttcatacacctctaataattctttccctatctttgatagttctctctctttagctactttatagccttgctcaactaatgaaggatattctccgttaatcatctttttaatgatttcaacaaaatcatctgtgtggttacctttgtaacagttcacgccattttctaaccaatctgaaaaaacaggaatatcacgcagtaaaacattacatttacttgccaaagcttccaatacaactattccctcagtttcttctcttgatgggaaaaagaatatattacttcttccataagcccctttaattatatcaccgctaacatagcctggtaaaataacattttgaggtaaatcatctagtaaatctttaatcttttttgtaggacgtgataatttaatatcaccaaaccacataaatttatactcaggcaatttctttgccaccgatacaaaagtatcaaatccttttctttcaaatagccaacctaccgaaataataacaacatctttagaatcaattttgtattgctgaataaacgattcaatttgttcttgactaggattaaactgtgtcaaatcaacaccattcgaaactgctttaattggaagtgtaattccataagattctaaaatccgctttgaataaggagtcggagttacaatataatcaccttttgtatacatactgatcagccattttttataaacccctgaaacagtattagaaaacataaaagaatttttaaaatcttcttctgtgctatgagcatgatatacaatctttttattatactttcgtgcttgatttattatcttaaaactatcaggccatacagtattaatgtggagaatatcataatccaaatcatccttatctgtagtataagggattcctgataattctaatgcttttttttgatggacaaaagcacgaccaattcctgattttttgatagcatcttcttgtccaaaatataatttaattttcattttatcaccatatctattatactacaaagtagtcctaatttaaaggattataagtaaggcatacttcggtttagaacaaagaaaaaaggatacgcagaggtatccgtaaataaaaaaagaaccggcagcttgctattgtcgcaccttggtactatcttcgccgttatgatgcttaacttctgtgttcggtatgggaacaggtgtgtccatcatgctatcgctaccagatcttcttttctaagcaattcctttcgagaatcactcaaaactagataatagttttcttgcgtcttttgtcttccactttgtcttctttcagtttcaagccttaaccctttttctctaggttaagtcctcgacctattagtatcagtccgctgaacatgtcgccatgcttacactcctgacctatcaaccttatcgtctttaaggggtcttacttacttgcgtaatgggaagtctcatcttgaagtgggtttcacacttagatgccttcagcgtttatcccttccatatttagctacccagctgtgccactggcgtgacaactggtgcaccattgatatgtccatcccggtcctctcgtactgaggacagatcttctcaaacttcctacgcccacgacagatagggaccgaactgtctcacgacgttctgaacccagctcgcgtaccgctttaatgggcgaacagcccaacccttggaaccgacttcagctccaggatgcgatgagccgacatcgaggtgccaaacctccccgtcgatgtgaactcttgggggagatcagcctgttatccccagggtagcttttatccgttgagcgacggcctttccattcagcaccgccggatcactaagcccgactttcgtccctgctcgacttgtaggtctcgcagtcaaacacccttatgcctttgcactctgcgcttgatttccatccaagctgagggtatctttgggcgcctccgttactctttgggaggcgaccgccccagtcaaactgcccacctgacactgtcccgttgccagttccatggcatccggttagaactccaatacaagaagagtagtatcccaacattgactcctcacacactggcgtgcatgtctctcagtctcctacctatcctgtacatcttgcatcaaagtccaatatcaagctacagtaaagctccatggggtctttccgtctagtcgcgggtaacctgcatcttcacaggtactaagacttcaccgagtctacagctgagacagcgcccaaatcgttacgcctttcgtgcgggtcagaacttacctgacaaggaattttgctaccttaggaccgttatagttacggccgccgtttactggggcttcaattcaatgcttcgcttgcgctgacacatcctcttaaccttccagcaccgggcaggcgtcaccccatatacgtcgtctttcgacttagcatagagctgtgtttttggtaaacagtcgcttgggccgtttcactgcggctcatatctctatgagcactccttatccctaagttacggagtcattttgcagagttccttagctatagttctctcgctcaccttaggattctctcctcacccatgtgtgtccattttcggtacgggttactgtatgattatcactagaagcttttcttggaagctggcttcacggacttctgtacttgccgcagctttccatacgcctcacgcctttgcctttcgacagccggatttgcctggctgtcggctacctcgcttgcacctgcatttccatcagcaggatccgctagccttctccgtcactccatcattcataccgtaagtacaggaatctctacctgttgtccatcgactacgcctctcggcctcgccttaggtcccgacttacccagagcggacgaaccttcctctggaaaccttgggttttcggtgcgtgggattctcacccacgtttcgctactcacaccggcattctctcttctatgcgctccacggctccttacggtaccgcttctccgcacatagaacgctcccctaccactcacgcttacgcgtaaatccatagcttcggtaatatacttagccccggtaaattatcggcgcagagtcattcgactagtgagctgttacgcactctttaaaggatggctgcttctgagccaacctcctagttgtctggacatctccacatccttttccacttagtatatattttgggaccttagctgatggtctgggctgtttcccttttgacaatggaccttatcacccactgtctgactgccgagtatatctttgtgacattcggagtttgattatgttcagtaccccgagatggggccatcacatattcagtgctctaccttcacacgactttacctcgacgctagccctaaagctatttcggggagaaccagctatctccgagttcgattggaatttcacccctagccacaactcatccgccaacgtttcaacgggggtcggttcggtcctccatcgggttttaccccaacttcaacctggtcatggctagatcactcggtttcgggtctacgacatgcaactttcgccctattaagactcgctttcgcttcggctccgcatatcctgcttaacctcgctccatatcgtaactcgccggttcattctacaaaaggcacgctatcaccctttaacgggctctaacttcttgtaagcatatggtttcaggttctatttcactcccctcccggggttcttttcacctttccctcacggtactggttcactatcggtcacagaggagtatttagccttaccagatggtcctggtggattccgacaggattcctcgtgtcccgccgtactcaggtgctgtctcgtgcttcttcactatttcggctacggggctgtcaccctgtttcgccggacttcccattccgttcgcctataatgatttcttgctctttgccgacagtcctacaaccccgatcctaagatcggtttgggctcttcccctttcgctcgccgctacttagggaatcattcgtttattttctcttccttcaggtacttagatgtttcagttccctgagtctcgcctctctgaagctatttattcacttcaggatacctggtctctactccaggtgggttcccccattcggacatcgacggatcgttgcatgcttactgctaaccgtcgcatttcgctgtttgctgcgtccttcttcgcctctctgtgcctaggcatccgccatacgctctttcttactttacctattttggtgtttgcttgattactattttcaactatttactaaaatccatccatccgtttcgatttatgttttttagtgatgaaaattcttagttttcgacttttctagaaagacctcaataataacaattactatttcgatctcattttctatttctatcgcaatttattttctattatccagttttcaatgatctctgagtcatacctgagtatcactcaaaactaaacagtatcttcgaaacatcacttctcttgtgcatcatcttcgatcatgcgtttctccttagaaaggaggtgatccatccccacgttcccgtagggataccttgttacgacttcaccccaatcatcaatcccaccttagacagctccttccttgcggttaggccaccggcttcgggtgttatcaactctcgtggtgtgacgggcggtgtgtacaaggcccgagaacgtattcaccgcgacatgctgattcgcgattactagcgattccaacttcatgtagtcgagttgcagactacaatccgaactgagaatggttttatgggttttgcttcacctcgcggcttcgcttccctctgcaccatccattgtagcacgtgtgtagcccaggtcataaggggcatgatgatttgacgtcatccccgccttcctccagcttgtcactggcagtctcgctagagtccccaacttaatgatggtaactaacgataagggttgcgctcgttgcgggacttaacccaacatctcacgacacgagctgacgacaaccatgcaccacctgtatctcatatagctatctctccatctctggagcctttatgagtatgtcaagacctggtaaggttcttcgcgttgcttcgaattaaaccacatgctccaccgcttgtgcgggcccccgtcaattcctttgagtttcattcttgcgaacgtactactcaggcggagtacttattgcgttaactgcagcactgaactttgacatccaacacttagtactcatcgtttacggcgtggactactagggtatctaatcctatttgctccccacgctttcgggactgagcgtcagttgcaggccagatcgtcgccttcgccactggtgttcctccatatatctacgcatttcaccgctacacatggaattccacgatcctctcctgcactctagctgcctggtttctatggcttactgaagttaagcttcaggctttcaccacagacccttgctgccgcctgctccctctttacgcccaataattccggataacgcttgccacctacgtattaccgcggctgctggcacgtagttagccgtggctttctaataaagtaccgtcactcggctaccatttcctgtagccgccgttcttcctttataacagaagtttacaatccgaaaaccttcttccttcacgcggcgttgctcggtcagggtttcccccattgccgaaaattccctactgctgcctcccgtaggagtctgggccgtgtctcagtcccagtgtggccggtcaccctctcaggtcggctacgcatcgtcgccttggtgggccgttaccccgccaaccagctaatgcgccataagtccatcctctaccagtgctttgaggcacttttaatacggtcaccatgcagtgtccgtacctatgcggtcttagctatcgtttccaatagttatccccctgtctagggcaggttacttatgtattactcacccgttcgccactcgagcacaagtgctcgcgttcgacttgcatgtattaggcacgccgccagcgttcatcctgagccaggatcaaactctccattgtttatttaaacaactcttcgtttgtttagctcttttttcttttttatccttctggatattgacgtgtgtttcttaattctgtttagttttcaatgatctccactcttatctcgagtgcatgattattctatcactaatatttgctcttgtaaagaattttatacattttttttatttttttattaagtttccaaaaaacagtgtaataatcaactatatttgcagtcgaataagaaaaaatcagaggatttttcctctgatttaaactttttatgccattctatctaatcttaaacgacgttttttagcatcagctaaacatttctccattaatgcctccgcatgttctggattaacctttaacaattgtgcaaaacggttttcagataacaagaaatctttaaatttatcaaagtctggtgctttagaatcaacttgcaaaggattctttcctgcatcttcaagacgaggatcatatctcaataagttgaagtatccacaggatacagcatctttttgttgtctttgatgatttgcaagaccacctttaataccatgttccatacatggagagtaagcaatgattaaagaaggtccattataagcttcagcttctttgaatgctttaattgtttgtacaggatttgctcccatagcaacttgagcaacataaacatgtccatatgccatagcgatttgtgctaaatcttttttagcagctgatttacccccagcagtaaatttggcgattgatccagcttgagatgatttagaagattgtccgcctgtattagaatatacttcagtatcaagtactaaaatattaacattttgattacttgcaataacatgatctaatccaccatagccgatatcataagcccatccatcaccaccaatgatccattgagatttacttaccatatctccttcatgatttaacaattctttaattgcttcgttgcttgaagctttaaccgcagtcatgatttgaggcacaagctctctttctttagcgcgatcaccattgatttcaacatactcttccaataaagccttcagttccggttcacaagcatctttattttcttcaataatacgtaatagatgcccaactttataattttcagctaatttcattccgaaaccaaattcagcattatcttcgaataatgagttagcccatgctggtccttgaccatttccatcaatcgcacaaggtgtagaaggagtagaaccactataaattgaactacatccagtagcattagcaatcatcatatccttaccaaataattgtgaagccaaacgatagtatggtgtttcaccacatccaccacaagcacctgaaacttcaaaatacggtctcatgaaaccaacacctttagctgtagttaatggatacttatcatcacgatatttaacattagcatacatgtaatcagctaatggagcatgtactaattcatctttcacactaaccatttcaagagctttttcacctttcttacctggacattcagtaacacataaaccacatccaacacagttatccggtgaaacttggatacgatatactaatccacccatatctttacccattggaactaaaacatcatcaccaatgttttctggtaaattagccatttcttcttcatcaagtaagaacgctctgatcgttgcatgagggcaaaccattacacagttattacattgaatacagttatctttattccaacgaggaacttcagttgcaattgcacgcttttctttgattgccactcctgatttcattgaaccatctaatttatccatgaaagcagaaacaggtaaatcataaccatctaaactattgattactgaaacaaattcatcaaaatgttcatctccagtagtacttctagttgcagttactgttaaatcagaccaaaaattatcaacagctacttcttcaattgcgtctttacctgcatcaattgctttgtagttaagttggacaatagcatcaccttttttactatatgttttctttgccatttctttcatatattcaacagctttttcaattggtaagatttggggatttaatgcaaagaatgcagattgaagaattgtattagttcttcttcccataccaatttcaccagcaattttattggcattaattatatagaatttagcctttttatctgctaattgtttttttactcgatttggtaaataatcaataatttcttcttttgagaactctgtatttaataagaatgttccaccatctttaagattttttaacatatcatatttaattacatagttgtctaatgaacaagaaataaaatccgcattatttacataataagtagctctgattggagtattcccaaagcgtaaattagagcgtgttgcccctccagcttttttagaatcataagcaaaataagcttgtgaatataaatcagtatgatccccaatgatttttattgaagatttattagctgaaacagtaccatctgaacctaaaccataaaatagacatgctgtataatcagcatcaacattaaattcaggatcctcttttaatgatagattagttacatcatcattaataccaattgtaaatgaagtaaatggagcatcctctaataaatgatcatatactgctttgatttgacgaggagtagtatctttagaacccataccataacgtccaccaacaattgctcttacatgtttaacgtctttaaggacactaacaacatctaagtataaaggctctccagtagcacccatttctttagtacgatctagaacagctactttttccactgtattaggtaatacttttaataagtatttggcagagaaaggacgatatagatgtactttaattaaacctacgcgatcaccgcgacggttcatttcatcaattgtttctttaattgtttctgttactgatcccattgcaacgattactcttgctgcatcaggtgccccataatatgtaaatggagcatattctctaccggtaatttcagaaatctttttcatataatcagcaactacttctaccactgcatcataatgcttgttttgagcttcacgaccttggaaataaatatcatcattttcagccccaccgcgctcaattgggttagtgtgtggattcattgcatttttcttgtatttagcaagagcctctttatctaaaagactttctaatacatcataatccattacttctactttttgaatttcatgagatgttctaaatccatcaaagaagtgcattacaggaacagatgatttaattgccgttaaatgtgcaattcctcctaaatccattacttcttgaactgagtgtgaacaaatcattggcattccaacttggcgacaagcataaatatcttgatgatcaccaaaaatatttaatgctcttgttgcaagtgctcttgctgatacatggaatacaccaggtaataattccccagcaatcttgtataagttaggaatcatcaataataaaccttgagacgcagtaaaagtagttgcaagtgcaccaccttgtaacgccccatggacagcaccagcagctccggcttctgattgcatttcaattacattaacaggtgaaccaaagatattttttttaccttgggcagaccatgcttccgcattttcagccattggagatgaaggtgtaattggataaatacttgctacttcagtaaacgcatacgcaacgtgcgctgcagcagtattaccatccattgataaaaactttttagccatttttaaaaatcctccttttgcataccattattatactacgtagccttttgtattgctagttataattactaaaagaccctcacaaatatagaaaggcattattttttcattttaaataaaaagaatgtttttatttaacaatccatttaccttgaatccatcaatctttattaaaaataatataacaaaaaagctgatcactaaaaccgatcagccaattatattcttttaaattaatatatttaatcttttaatgccatatatgccgcaatcgcaccaaataaatagataattgtacttaacacatcacctgttatcatattttggaaacaatatttgaatgtttcaactagcatgctgacattaaaaaaaggtagcgttatacttataaaaattgcttgtgccacgacaattcctaaaacaaaagtaactgcagcaataatggctaattgttgaccacttttattcaatactttttttattgcctgagcttcaaaaattccaattaaaatagtaaagtatgaaaaattaaaacctattttagaaataatccaggttaaaatacatcccataacgatcgttgaaccaaatccaactaaaatagctattaaataatctttcccatatactttttgatcattattttgattaaaaaacgcttgcgcttcttttctttgtttatactcttcatatttctcttgaaaactcatcatttaacatcctttacaagtgaatttatatatgcttgaaccttttcttttaaatcttcgcgctttaatgcaaaatcaatcgttgccttaataaaaccaaacttatcaccaacatcataacgaatcccttcaaagtcatacgcatagaccgcttgaatatccattaaacgtttgatagcatctgttaactggatttctccaccagcacctttcccttgagtttctagcaattcaaatacttttggtgtcaaaacatatcttcctaatactgccatatcgctaggagcttcttcaactgccggcttttccaccatattatttaacttaactaaacgcccaccattttcacgaggatgcgaatgtgacggactgacaattccatatttacaaacatctttatgttcaactgtctgtaccccaacaactgatgcttctttatttatatacgcatctattaattgctttaatgctggctcaccaccatcatttacaacaatatcatcacctaataatactgcaaatggctcatcaccaataaatgattttgcacataataccgcatgacctaatccctttggctctttttgacgaatataataaatatttgccatatcagcaatatcttgtatcattttaacttgttccattttacctgattctgttaaacgcgcttctaattcatacgacttatcaaaatgattttccatcgcatgtttatttgaattagtaataatcaaaatttcttcaattccactatccactgcttcttggataatatattgaattgttggggtatcaacaattggcaacatctcctttgctagtgctttagttgctggtaaaaatcttgttcctaatccagccgctggaataattgcttttcttactttttgtttcattgtactctcctctatatgtttatattttactatatctgattattaattgacaagattatgataattttccggttttttctttttccaaatgcgtaaaggcataaatttgataattagtaaagttgcaataaaaccaccaatcatacctgaaatatgtccagataaagaaatcgaaggcaccaatatagaaatcagcagcatcaatagaacacttgacgatatttgcttgaataaatatgcataaacatctttaaatttccaagccaatgctaataaagctcccatcaatccaaaaatagctccagaaatacctcccataatactactagcaccatttccagtcaaaatataaaaaactgttggtaaaatcgtagttgcaagggcagaagcaatcaaaataatcaaataacgcttcattcccaacaaatattccataactgagcctagattaactaatgaataacagttacaaaaaatatgcataattccaaaatgaataaagtttgcactaattaatcgccaatattgatttcctgccaaaaccaaaattggattaaatccacctgctctgattccttgataagcattcatttcaaaaccgtatttaacggttgtataacaataaactaaaatacatattccaatcaccccggctgtcactggatattttttataatcaaaattcattctattctcctataaattcaaatattgacatctgatcaatattgacttctgcatcttcaacaatttttttgtttctatcataaatcatatcgaacgaataatcagacaatacatcttttatatatattggtgtcactcccatatcaagtaaccgatcatttcctaaatataacccttcaacagctaaaggtgtagtccatttattgtgtaaattttgcaacgaagtaaaccatgttgcgccattattaatactacttgaaacaataatttgatattttgacaatgcacatacatagctattacgctcaattgcattagttacatcaaaatagcagtttggatcctcagcactcagcatcactaattgtccggatttaatatatctagtatagtctttgcttttagcaccaagtcgctcacaaacaaaactaatacaatgacaaccatgataaagtgcgtaatgcaaagcaacatcatcaattcctttagcatcattggaaatgtaaattagattatcttcaattgctttatctaccaatcttttggtataggcgcgatcttttttagtaaccttattaagacccatcaaagaaattccttctccaactaattcaatattaccacaataaaacacatataatggagcccttttctttaggtgtttagttaacaatttagggaaattatcttcatattttgtagtaacattaattccattcccctccagattattaagaacacttaaaaaaatattcatcgtttcaattcttcgtgccattttataagcaataaattcatttatttctaaaatttcttcaagttctgtctgattcatcgacagcaaactagcaggtccttttaaccccttcttttttataatccgctcaattaacaaccattcctcattagaaagcgggacctctttatacgcttttaatcgagcacaaaacagcatcattgcaatactatctaaattaagtttgattcgttccacgtacatgtgccccctttaatattcattaaaaattcttttaatttcttttgtattctgagtaacacttaaagcaagcattagaagcactctagctttttgtcctgacaaagtattagacggtatacagacattatgaggatcaaaaacatcactctcatatacaattccctgattaacccgagacgctctaacaaaaatgattcctttagcagctagtgtttcaatttcattcagccatgcttgactataattaccactaccgctgccaattatcacaatccctcgatgattctgagccatcatcgtcaaaatatcaggtttagcaccagcatagtaatagacaatccctaccggaggcaattcagtaattggcttttcactaaaaactgattgcaatgtatgttttttaaaagttcttgaaaacatcataactttatcatcattcatataacccaaacatccaaaatctttttgatcaaatgcatcagttttaaaattactaattttttggatatctcgccctgaataaattgtacttgaaaagactgccattacgccatgtcccaaagcatcatcacacgaagccaaacaaacagcttgatataaattaatcggaccatctgcactagttgcactcgctggtctcattgcccctgtcaaaacgactggcttatatgtattgattgtaagatttaaaaaataggctgtctcatccaatgtatcagttccatgagtaactacaataccatcaacatttttttgagaagccaaatcatttattttattagctaaaattatccaatgttcttcattcatctcattactatcgacattaaaaagctgaattgcttttaaattagcaacttcattaatcattggaatagagtcaattatttccttaatattgatttttccagcctgataattagttgcttttccaactttgccacttcctgcaattgttccacctgttgctacaattataatatttttcattttatcaccatatctattataccaaatatcctactttacacaaataaaaaaacgtctctttaaattaagagacgtttatcagctatttatcagcaactaatactttatcagtagtgtgttctaggataatttcctcagcagcagcttgagcagcagctaaacgtgcaattaacacacgatatggagaacaagatacataagttaaacctgttttatgacagaatttaattgattctggatctccaccatgttcaccacaaatacctaatttaatttttggacgaacactgcgacctttgtttgcagccatttctactaattgaccaacaccactttgatcaagcgatacgaatggatcaacttgaattactttacgattaatatattcaggcaagaaacttcctacatcatcacgagagaaaccaaatgtcatttgagttaaatcgttagttccaaatgagaaaaattcagcatgttttgcaatttcatcagctgttaaagcagctcttggaatttcaatcattgtaccgatcttatattcaatttttgcatttttagccataattgcggcatcaattgcttttgtaacattatctttcacataaacgatttcagattcactaccaatcaatggtaacatgatttctggtacgattgtacatcctaattctctttcaacatcaatcgctgcatcaataattgctctaacttgcatattatagatttctggatacgttactgctaaacgtgaaccacgatgtcctaacattggattagtttcttttaaagttgcgcccttagttttcacttcttctaatgtttttccaagtttatcagcaactgcttgatattcttcatcagtatgtggtaaaaattcatgaagaggtggatctaataaacgtactgttaccggtaatccaaccatcgcacgatagattcctctgaagtcttcaacttggaatttatataactcatctaatgccttaattctttcttccactgtatcagataaaatcatttgtcttacatattcgatacgatctccttcaaagaacatatgttctgtacgacataaaccaataccttcagctccaaatttaatagctacagccgcatcacgagggctatcagcattagcacgaacttgcaatttcttgatttcatcagcccaagacatcaattcagcaaaatcacctgttaattcagattcttcagaatctaaaattcccatatatactttaccacttgtaccatctaatgaaatttctgttccttctggataagtttttccatcaattgtaaatgttcctgcatcataatcaatcgataatgcttttgcacctacgatacagcatttacccataccacgagcaactacagctgcatgactcgtcattcctccagtagaagttaaaataccttcacaatcaaccataccttgaatatcttcaggagaagtttcgtgtcttactaaaataactttttcaccagctacagcttgttcatgaactttttcagcagttaaataaactttaccagcaccagcacctggtgaagcaggtaatccttcaatcaacacttcagcagcagctaatgcagcaggtgtaaagttcggatgtaatagttgtgagatttgatcaggttcaactcttgtcattgcttcatatttattgattaaaccttcatgtactaaatctacagcaatttttaatgctgctttaccagtacgtttaccatttcgagtttgtaaaatatatagtttaccattctcaactgtaaattcacagtcttgcatatctttataatgtttttctaatcctttaacaattgtaactaattgtttatagatttctggcatatcttcttctaatttagcaattttttgtggtgtacgaataccagcaacaacgtcttcaccttgagcgttaattaaatactcaccataaatatgattatccccattagcagcattacgagtaaataataccccagtacctgagtcatcacccatattaccaaataccatttgttgtacgttaacagcagttcccaaatcatgaggaattccatttaagttacgataaataatagcacgatcattattccatgatctgaatacagctaaaattgctcccattaattgttctttagcttcttgtggaaagtctctacctaattgagttttgaaaatttctttatattgaggaataatgatattttcaaaatcttctgcagtgatatctaaatcactttcatatccctttgaagtttttaattcacttaatttagcttcaaataactctttatcaacttcacaaactacatcagagtacatttgaataaatctacgataactatcaaaagcaaaacgacgatttcctgtttgtttagctacaacttcaacagtttcatcatttaaacctaagttaagaattgtatccatcattccaggcatagaaaattttgctccagaacgaactgaaactaataacggattatctaatcccccaagttttttatcagctaatttttctaatctttctaagcagtcatcaatttgttttttcatttcatcattgatgatcttaccatcagcataatattcattacatgcttcagtagtcactgtaaatccttgtggtactggtaaccctaagttaaccattgcagccaagttagcccctttaccacctagaaggtcacgcatcatttcgtttccttcgctaaacatataaacgtattttttcattcaatctaatcctccttagaattaatacataaatatattatacacgtgttagccttttcattcaagtgtaagcgcttttaaaataccatatttttatacaaaaaaagattgtatttttaaaacacaatcttttcaccaaatatttattttttatttgcaatttcgatttcaatctttcgattattaatcttttgcttattacacttatcaacaactttattgattaccttcttattaatatcaacaaatgtaaattttcgtttgatatcaatatctccgatatcttcttttctcacacctgctttagaaacaaagaaattaacaatttgtggtgctttgacacgatccatactaccagcagtaataaaaattcttgtataatctttattatttccacggccacgttcacgccttttaccttcagaagcctcctgaatcgtatcacgtttataatcatatcctaactgttcttggaatgtcatatacattaatgctgccgtaaagtctgctaacattgttggatcaatttcatttaccaattgcttgaacttcttatggttaccagccaaaatttgatcttcaactttacttaccagagttccaatttttgcttcagaaatttcttgcagagttggaatagtcgctttggtaatagaagattttgttacacgctcaatttgacgtaaaaatcctttttctcttggtgtaataattgaataagcttgtccttctttatcagctcgaccagtacgaccaattcgatgaacatatgattcaatatcttgtggtaattcataattaattacatgtgttacgttttcaacatcaataccacgagcagctacatcagttgcaattaaaaaattaattgttccttttttaaattttctcaatgtattcatacgatgattttgtgataaatctccatgcatcgcttcaacattataatttgcctgctgcatttgttcagttacttcatcaacactacgttttgttctacaaaaaataattcctgtttgaacattagcgacgtcaattaaacggcacattgcttcaaaacgatctttttgtttcacttcgtaatagaattgtttaacagatgtagctgttgtttgttttgataatacagctacatgttcaaaattatcatgcatataattttgagcaatctttttaattcctgctggcattgttgctgaaaataaaattgtttgacgatcatcatcaactttttctaaaatagtttcgatatcttcaacaaagcccatattcaacatttcatccgcttcgtctaatactacgaattttacgtcgtttagtttcaaaacattacgacgcattaaatccattactcgccctggtgtccctacgataatatcgattccttttttaatggtccgaatttgtcgctctatatcactaccaccgtatacgcaagtaattcgacttccattatatttaccaatacgttccatttcttcatggatttgcattgctagttcccttgttggtgacaaaatgatagcttgtggtaactttctttgagatggagttatttttgacaacaaaacgctcccaaatgctaaagttttaccggtaccagtttgtgcttgaccaattacatcaactcctgtcaataatacaggaattgcttcttcttgaatttttgacggtttagaaaaccccatatcttcaattgcttttaatacttcattacttaatcctaattcattaaatttgttttcaatcattctttatacctttctagacactttggtgagtatagcataattacgcgatatatacaaacttatttgcataatttgttttatttttttatttataatgagattatttcaataatcatagaattgactactctttactgttataatcatcatagataaaatgttgtaattggaggaacttatgatggaaaataaaattatttggcaagatcgtaaacattttatgtggtttccaattagttttactaaatatgaaataaaaaatgatcgcctatatcaagagactggcctatttagtactcactatgacgaattgcttttgtatcgtattaccgatttatgtctacgaagaaatttatcacaaaaaatctttggtactggaacagtaattttgtacactaaagctgacagtgaacgtgaaattcatttaaagaatataaaaaatgctcgagaagttaaagatttaatttctaagttagtagaagatgcccgtgataaaaagaaagttgttggtaaagagttctttgatgaaaatttaaattttgaagatcattctgaataaaaagcatcgtcttatcgttagtataataagacgatgcttttttattattcagtccaaaatttattagttgcaatgtcataacataaacatgtttcatggctttcaaataatgtatcttcatcaccatccttgaacatatgaatgatacgatttaaagcgtgataaagatattcaaaatcattttgtttaattgttttatctttgtgaagaatgaaaatattacgattaactccttggtatcctttaaaataagctcgattagtatcataaaaagttattaaatattctgtattatcttcctttaaatcatcattattgttatataaatgaatttcatatttatcatcaagaatataatagatgactttcgttgttaaaaaatcagcaccatttttaaataagcggtaattataaattccactaaaactcatttctttcaacatttcataacagtcagccaaaagaccgtcaataaactttctttgactactatttaaataatatacttgttcaggacgtacttgtttgacatttttcaacatttgattaaacttctctaatatttttttatcagcttcaataatgtagtcccaaacgatgatattaatactataaacattattaccagtaccaataatataaactaacttctgatctaattctaaaagatctgctagtttattgtttttactattttttcttgtaacaataatatcatcatctttttgatatttataagctctcgaatcacttagcattaatttttcattaataattgagcttaattcatcaaaagtaatattttcctcaatgtctaatgtcaatttagtatctttatatattatttttaatctatacttatttgtcataattaccccacttctacttacttttacttttattataacaaaaaaatattttattaatagtaatatgaacaaaatagtcatgttttttcactttaatatctcgttgttattaaactaaaatgatagaagaattaagcgctaaagaaatgttatttcaatacatcttatgttgttattaaacgaaggttgtgacttggctatgttacttcggaatatatttcaatacatcttatgttgttattaaacatcaattaaatttcttacaaacttcaacaactctctatttcaatacatcttatgttgttattaaactaactatctttgttttgcgcaattgctattacctcgatttcaatacatcttatgttgttattaaaccatagtttcaccaaactctagcataccctttttaaaatttcaatacatcttatgttgttattaaactgtgttgttcgtttaacgacttaatatcttctcgttgatttcaatacatcttatgttgttattaaacgttgtgttgtttgtatgttcacacataagcatttatttcaatacatcttatgttgttattaaacgctatgcagattggactttggaagatatttatacatttcaatacatcttatgttgttattaaactgttgcggtagtgtaaggtatagacactactgcccccaaatttcaatacatcttatgttgttattaaacaatgtatgtggtttcattaaacgaggtcaataataatttcaatacatcttatgttgttattaaacattaggaaatttgttaaaaggtctattcgttcctagatttcaatacatcttatgttgttattaaacgagccttgtatgaggaagttgacattaataaaaaaaatttcaatacatcttatgttgttattaaacagatcatatttctaaggtaatacctgatataactatatttcaatacatcttatgttgttattaaacttggaaatgcagtttgttaacaatacaagatttacaatttcaatacatcttatgttgttattaaactacaacctcgctcctctaatccaattcacgaagttaatttcaatacatcttatgttgttattaaaccctagtaaataagccattttacactttctattatacctcaaaacctatatctatcaatacttttctacttttttaccaaatgattttacttttttataattgctagtaaaattctcttaaacgcttactctcccaacagttttaggacattaaaaagaaattgagcctggtaaattatataattaaactatcttcatttccctctttttgactccctaaaatttcttcatcaaatgaatcctcactctgtaatttaataatacttacacaatcttcttctttgtttatagctttttttagttctttttttaataaaattaatttagaaggggtaataggacccttaaaaatagaatattgataatgaggaagatattttttacatatcttaaatattttatttactcttttttcctcaatatcgtaacagacgattacatagttatgattttttattttcattaatatttatcctttatagaaaatggtataaataatttattttcaaaaattgttttaattaatttataaccatcatatttaatagctgttttatatgttatctttctctttaatttagtatgtaaaaatttagtttccattctattttcaaaagcttcaataaatatatccctacctttatcatttaaaagacaataattagttttcttatcaaaatgtttctcaaccgttaatcttttagtattgactaattcaaagattgttttaaaaacaatgatcggtttaaatacttcacttaagtctaaagacaaagaaaatctttgttctgtaggttcatgtaaaaaagaaatactttgatttaagtgagtttgatatatcgctgaaattgtttttgtataaagtaaagtgtttccaaaagaaatcagtgcattaattggattatcaggcggtctctttactcttttgttcattataaaatcttcaggtaatatatatctaaacatactataaaaacgttgccatatttctccttcaaccgccataatcattttaatatcttctgctttttttaaacgttttggcacctcttttcttaaccagtctattgtttctttaacctcatttttaccatgcttataatagtgatataaagtttcatcaacgttaattgcaatgccattaactattgcctttgcaatatcaatacgataattattaaatgtttcaacctgtttaatcaacaatttaccactagtatatttatcctttggataaaaggtaccactataaccctgataatagttaaaaaaatgaataattatatttttagatgagataaaatctaataatttagtattaagagaaatttcatttaaacaatatatctcttttatattttctactggtaaatatatattcttaccactttttctaaaacaaagtgaatcatctttacgttttaaatctcccatactagttatgtatttagtacttttcattacaacacctcctatatataacaatatgcataatatgcacattttttacatttactttcatttaaaactagtggtatttcatcattttctaatagttctttaattttaataacaattttatctaattctttttcttcaatttctgttagctccacttcaataaaagatttattttgtttattcttttcaattacttctattcgtccttttcgtattattccttttgactttaaaattttaagataatataaaagctgccactttgctgcaactaaatcagcatcagacttttttgtttctgttaaatattttgcagttaatttatccaatctaatattgccaattgcaatctctgaattcttatcatctttatacttttcttcatgcaatgctttaccaatcttcacattttcactttcatcctctaaattaagtcgattaccatgaagataacattgtctttgacaatgaaaataatagtttattaatgttccatttacttccatattcttacctctatataaataactcatcctcagtttcaaaaagagcagtattcaatttaccatctaaaatataatcatcaccattttcaatataataaatatctccaacctgttctttgaaatcaaattgattttttttaataacttggtacataaaataattcatcatacttttaaccactgacaactcatatacttttttagcataatccatttcattatttttcaataaatctacatactgattccaaatagctttaccatcaaattcttccccatcaatattaattaccgttcttcctaaaaatatcgttactctgtctctagtatctaatatcaattccattcgtttacttactgcctgataatctaaacacgcaacactttctctaaaaaaattgggaacatttttttcttcaggctttttagctctatttgctagagtcttaagaagtttttggtaataataattaaagttcttttttaacaatacttttttcatatcatcattaaacaatgttaaatttttctgtgcaacacgttcatcccccttataaatattggttgccttatttaaattaaagaaatatactattccttttccatcttctttacatgagcgatttattcttcccataaactgttcttcactatcaagtttagatatatctttataaccgatatccatatcaatatcgacaccggcttcaattacctgggtcgctactaaaataagatgttttgaagttttaactgtactaatgattttttctctttctaatacactatcaaaaccactaataaataaaacttcacaatctaattctatctcttttaattgacgatagaacttttctgcactttttctaacaataaactcaatcattatttttttctttaatttattcatctctaaaacatgatttaataacgattcttcagtattttctacatttattagactataatctgtttttactcgatctttaaaaattggatttaaaaaatattcttgaggatctgttattaatgaaactgaattactacgatcatctgtaagtaactctaaatctggtaatgtcgctgacatgataactatttttagattaagaattttagtaaattcttttaagaagatgattatctcgttccatatttcaattcgataattttggatttcatctaaaactattactgaattagcatattggcatagaccaaaggctgattctcgattatttccaaagaaagtatcaaataaacctacatgggttgttagaataattggataagttaaaaattggcgatccaataatgctttttgatattcacccgaaaagttttcatcttcatccttttttaatggggttgtagaattaacgacagcaatattattcatagccttactattaccaaaaattttatttaacgatgctagattttgttctactaatgtattaaaaggatatacatatactatcttatttaaactatcatcatttttaattaaacgtaaacttaaatttaatgctgtgttacttttaccactcccggttggtgcttctatgtaatatatgtttttatcaatattctttatcaaatttttttccgcttctaaaaatatctttgttcttaatccattgattttttcttttccaacatcattctttctaatctttgtaactaattcactattatcatatagttccatgatttcactaaaatcagcatctttaagcattacattatttctattatcaccataaaattcacttgttgcataataatcacaaaaaaccagaagtgaatataagaatctaacatagacatataaatcaatttgcttattagtttcatattttcttagttttttaaataaattatcacgtcctttttgttttaaaggtataagactaaaaccatctttaaacaattttgcaaattcatcatcattaacccaatcaataattctcttttctaattcatcatcactatcaaacttatcaataaagcgtgttctaaaatcatcaattttactatgatgtcgagaaattacaaaagcatttatatagataatagattttaataatttgatatcactttttgttagtgtttttagtttatttaaataatatcctaaatagatatatgccgataattttgaatgatcagattctaaatttttaggtggatttaaataattcattactgaattattcattttatcattttgaaaaactggatttatttttccggtatcatgaaaggtaattgtgttaaaaaataactcattaaacatttcttttccttcatctgataacccctctcctaaagaaatgttaaaagattttaaaatcgaatccaatttctttaatttaaatatttctttcaaatatttcgtgcataattgaatatgttcattaattgtttcttgatgattatcatctctatgtccatagcactgatcaatattaattattattttttctagcgaaactagatatccatctatatccataatatcctccctttaataaaacccgcttaatagcgggttaataaaatacaatgtttttttcatcaaaactatatacactgccttcatccatataaaggttagtatgaataaatgtcatatactcatacaatcccgttttttcatttaatctaactggtaaactttcttgatatttataaaaatcaatatcaatatcttcagcttcttcaaaatctcccttaggaaataaacaggccaaagattcttcatcaatattacgtttctctaaatcaacaattacaggatcagtgatattagctggatgatcatttttacctaaatatggtataaaaatacattttttgtttattatagctttagctaatttatttgcctcctcattatccaacaaaacaataatatcccagcaaggatcttctagccattgttcttttataattaaattaccaccctgttctttggaagcataaccaaccgagttgttataatactgtattttttttgaaaaataaccttttttattatgaggcaaaatagataatttgatatcttttaatttttgataaaactctggtagttcaatcgtattattatagccctgataacctaaaattgccccaaatattcctaatagcgcaactttatgaatattaccaaaagtaaaataataatatgtattgacctccggacgcttaaaaaaagctgttttaccacttaaagtaaatttaagtgcctgcatatattacacctcttttttagtaatcaggttataagtttttgctttttgtaaattagattctaaaactgttgtttcaggattataatatatttcaatatttaaaacatcttctaattcatttaacatgttacattcaattgtaatcttgttaacatctgttttttcaaaactaatatactcacttaaatttggtaaatatgtatccaatttagtttccacaaataaagcaaattcattttgacatccctctttagcatttgatgaaaaagaagttgctgctactaaagccgttcttttaaaatttaaataatcttcttcagtgtagccatctgtgactcctaaagccacaaattctttataagcactaggattaattgaaaaaggatagaaataatgcgcttcattactaacgatcttagtacctaaagttgaattttttgcttcttcatctttttctttatcttttgaactatctctaaatggtgataagatttgttgttcttcagctacactttcactatatttattaattccctgcccaaactgaacagcaccagtaattgagatattatttttagcttctgcaaatgttgctccaaagtttttaacatcaaccgcactcattaaattagacaatacttctttagcatctttacattttcctaaatcatcaacatcaaataatttttcatatctttcttttaatgaattaggtactaatgttacagtgccatctttctgtggtgaaaatttcattgatttcatatataaaactttttgaccttcattatcccacatctttttcattgggtattttaaagccttatcactaccaaaaatcgttccatcagataagctttttggatagccagaaaaatcagcgttccaattcgacattattgaagatattccaattactccgtatactcttttatccattttccttttctcccttttcataaattaaattttctcctaaatatccagctaataacattccttgatcaattttatttacatcaagatattccataatcatcgaaaacatataattaaaccgtgttttccctacaaataaactgtaattataccgctgataaaactgttttaattttatttttaaaacccgatcatttctaataacaataaattgattaataatatcctgagttttatttttagccttactttttgattgcagataagctagtgcttgaccaaccgcaaagctatactctaaatcattttcaattacatcttgatgctcgctatttattttagttcgcaagctctctcttacattttccatattattctcctgtttattaaaatatttatctaaagcaaaataaagatttaactgcttttgagctaatcttatatattcttttctaattgaattaattacaacccctaatgctgcttttggtaatatatatccaatattatcaactcttccagcacgtgtccaagcaaaaattgcattcctacaggttaaaagattactcttgtaaacactatctgttttgatagcttttatgtcatccggagcggtaaaataattattaattaaatacttagaaaacaaaatattattaattaatttttcaacgtcattacgatatttatattctcgataacattcgtcgtctaaagcaccaataacattttcaaaatcaaataaaggatttagatattgtttataatcagtaacaacatccatatagtgtatttctaattctttaccttttttagttttaagataaaatccattaaatcccttatctatattttcagtattatctaaacaatagattcttttatcatcgtcttcatttatgtatacattgctcttaccagtacttactcgatttaacaaataatcaaaaaactgtttttgtaataatgcatcttctaaggaaaccatatatggaattttatgcatcctggttttattttctaaaaaaggcttcttagcatttaactgcagattataattgggtaatccataaaccgtaccgttatcataaacattataatcattgcaattaaatatcttggttaaaagataacgatttccttcatcaatatataattggtcatctacttcaaaaaagatttttaaataatccttctcattataatcaacgccttctaaattatatatatgctcttttaaccattgcttattatgtaacaatctttgttgatcaatcccactaatattatcatttacaaaattatacatctgtaaatctttacctttatatttgtcttggggattttctaaagccttgaagtatctttcaattgcttcatcattcattttaccattattaaaactttccttttttacaaataatgataaataattattggaatgaatcgtttttcctggatcttgtggtttattcatactcactaactgactttgataatcataaaaacataatttatcatatatttcatcttctggcttttcgattaaacaatgatctttttttgaatatttaattttttcaacatcataagtaccgtcgctatgtactaaaacataatccccgtcagccaaaattattgtatttaaaactaaatttgtattatctttaagctcttgcttaaaaattcgtaaacattcatcaagcattatataacctcctttcaataatatatgtaattaacaaaaccaaatcctctggcgttcatttctaacaaacctgctccaatagctaacattgctaatttttgagcattatcattttccgcaatttctaattcaatcatatcccctaacaatttaattcctttatattttcttgatactggaactttatttttaaaattgatttgataatataattgaaaatcttcattaatttcttcaccagttatatctttgtattttttgattaaattagtttttaatcgtttttcaaaattctctgttttaatgctgtttttccagtatccctgctctgtttttaaaatcactggtgtaagtgtatatatttttttgattaattttggtttaattattttaacctcagcggtcaaaccttgaaattctttagtccgatttttagctaaagtatcatataaatattgagctaattgataatctaacgttcttattctaaacacatacgaattatctttttgataaaccccatttttagctaaaggatacaaactatcaaaggtataaaacttatactgattagtctcatgtatacctaaaaacatattatctttaaccattacactatcaataaagtatgctaaataagtctgtgtttcttcaatttttatatctttcaataaatataattttatctttatttcatatacatccatctctatactctccatttttttacatatttttattataatatatatttatctcataagcaaaagcgcttacattaataacaacaaaaattaactgttattattttctagtaaaaatattttttaattatgtttaatactatattaaataggcgtcttttttaggattgatactaatatttatagtatctatatttacatttttcacctcattacttacgtttttattttttgattaattttattctcacttacgcacttttcccccttttcatatcttaataaaaaaatatattaacttagccccttaaaaatcaactccctactattacttttaatcattgctctaataaaaaatatgtgattataataaaaaaacctattagaattacaatcataatgattgtaattttctatataggtttattataattattttattaatatcgtaataaatttacaatgtgatattggtttaattactacactattatcaacaacatttatttgctcaatcttctcttcctttaaattagtataatatgcttcacttatatcaaaattaaaagttagtttatcaccaatatcctgatgatctttaccattaaatagacgaattatatatccttcaccatcttcactttttttgattgcactaacaactaagttattttcactttcaaataacgaattagtaactggtaaaatttgtttctcatcttcttgggcaaaaatcaatctaccatttaagaaatcagcatattcatatacttcgattggagtattatatgcttttgcgagaacatcaatatttgaattgttaatattacaattaaaagttgtaaatcctaatttaaaatccatttcttttaataactgggcagctggagttgcaatgattctttcgcctgaagctcgaccggggcgataaactaaattttctttacccataaaaccatatgttctaaacaatgttaatctaatttgatttccttgctcaccaatgatttcatattcgcgaaccccttggggaataaccgcaattcctctacttttattggcaagagcaacatagctttgcgttggttcaattgatattggtggttcttgccaagtagattgatcattgacccaattagctaattcttttggtttttctgccttctcctggtttcctaacccttcaagatataactccatttctttatcataagtgtttggtcgtttgatcaaaccaaactgctgatcagcataattgaatttagtcgtcagcgcactatcaaataagatgcataaacgatgtgataatccttgattatcgacatgtacgtttagatcaattatatttgaaccttttcttaaaaccacttctaaagttactggtaacttaatacttgtctgttgtttagcccgttcttgtaaatcagcaggaatatccattttataattgatcgttgtcttttgataaagactagagccagttatctggtaatcaaattcactgttaatagaaaatatttctaaatcctgacgtggcggcgagtaattgaagctgtcaccatcatcaccattttcaacaagaacagcttgattttgataatgataatcagctagtttatcatagatatcaagacttccttgcttattaactgtaatttgataatactcattttccatgcttgttatttcttgaagatcgtcattagatttatcatccaaatcaattgtatattgcacataacctaatgctggtacatctctagcttcgatggcaatctttgcttgatagactacacttggcaaataaatatttttactaggatttaatcgaattgtttgtgataaaacatagtccgtaagatctgttttttcaattacagtatatttaacatggttaccatgattatccttaattgcaaaattatcagctggtaaatatgtttcaaaaataattgtatcattacgtttttttggtaatgtattaaataatgttaaggtgatctcattattagttttattcttgattttagttgcaatcaaacgtgaatgtaactcaactaaattaaccgcaatatcccgagcttgtttatagcgcatatatacatcttcattagcgttatcagaaatacatgatccaattgaatcatgagctgcattttcaaataacaatttccaaatctcactaactgcactatggggataatcattacctaaatgatacgacattgttaacatcggttctaaaatattagtaacataattttgtacttgcgtatttaacactttcaaatcacttcgcgatgaaaaaatcgatttatgaatccgcatatgcttggcaattactaattcaccactcacttcttctaaatcaggtttttcactctttacatctttaatatagtcttcaacacaactaataatgtattcattatcaggatctttttcatttctttccttaatcaaatcaggaagatttttacgaataggagcctgatcaaaaccattagggaagtaaatatgttttgtagcactacggctgccggctttttcaaaacattctttttgccaaaactcatcacttgctttatcatcttcaggtatatttccaccaatataataaccaaaaggaatttgggtagtaaaaacaacactgccatcatcaccacgccaattataatcggtatgtttgaccatatcatcactaacgcctcgccaaaataaagtatcttcaattccaaactggcgatatatttgaggcatattacctgactgtccaaatgaatcaggaacataacccacattcatatactctccgaaagtttcacaacacttcattccataatacatatttcgaacgatactttcaccagaaattactagttgatcactttgagtataccaaggtccaatgattaattttttagcttggacaagttttttaattctttgtttatcttgtggcatccatttaatgtaatcttctaataatgaaccttgagcatcgaccataaaatatttaaaatcattatttgtctctaatgtatctaaaacgtctttaagatctttcattaaataaacttttgatcttgaagttgtaaaataccattctcgatcccaatgtgaatgagggatcacatgtacttttcttttcatattaactcctttaatttaataggaagattttcatcttcctattttttattcaattactatttcaatatcatcaactgatattgtctcttcttcatctttatcatcattaaaatcaacaaccattggtgctacaattgcaataaataaagctccaacaataattccaacaagataagcccaaccaccagtgattgaaacaaatccatacattcctccaactggcggaatatcagcagttgctccaagtaaacaacagattcctgctcctaaagctccaccaatcatattaataggaattaaacggctagccttaactaatgtaaaaggaatcgctccttcggtaataccaataaatcccataacccagttacctttaccggcttctttaaaacttggtgaaaaacgatttttcttaattacagtagcaattgcatatgctaatgggggaatacaaatagcacaattaatatatacatttggttgataaattccttctgtcattaaaacatttccagccatccatgctgacttattgattggtccacccatatctgaagcaatcattgctcctaaaactaatgaaaggatcaattggctagttccaccactacacatatctcttaaccacgatactaaagcatcattaattgaggctagtggagtcgcaagaataactcccataattatagcaacggcaccagttgctaaaaatggtaaaataactaacggcatcatttgctgcattgaatcaggtaatttgatatgttctttaccccattttacaatatatccagcgataaacgcagcaataacagctcctaaaaaaccggcttttgtattactagctaatgccccaccaattaaaccagctccaatagcaggtttgtcagcaattgaaaaggcaatgaaaccagctaatacagtattaactaagccaatacctgtccaacctacctgctctaataaatataagatgtgtaagaacccatcttttgttgcataagcatcaagactattgattcccatcgctacccctatcaattttggaatagccacaactagtgatgccccaataattaaaggtagcatataaccaattcctgacattatatgtcctttagcatcttttaaaaactttttcattcgttttacctctcttttcatattttatgttataatgagagtacacactactcactatagttttgtgtatgcaatttgactccgccaagttaaattgcttttttatttttgtgttgcttgaacacatttttttatgaccgcctccggagctttgatacaagttgtaatatcaattctaattaccggttttccttcaaaacgctccattcctagaattttttgatctgatgctacaattacaaaagctgcttctttagcctcttcctcagtaatcttgttgacctgacccatacttccttgctgctccatttttaaatcataacctaatttagctcctgctttttctaaggctttagctgccataggtgtgtgtgctaatcccgcaggacaagcggcaataccaacgattttcatttaatctacctccatattttttaatatataatcttttagcgccgatttattagttgaagattttaccgtattcttaaactcatcttctaataaacaagtagctaatttagatatcatctgtaaatgaagatttccttcattttgttcaggaactaacaatgaaaataaataattcacttttttatcatccatagttccccactcaattgcttcatcagttcttaaatataaaattgcagcctttttgacatggttactacgtgcatgcggaattgcgaatccatcttgcaatcctgttggaaattctgcttcacgttttattaaatcttcaagcagtccttctcgattgtcacaaatattatattcatgggctttgtctgcaataaaccctaataattgatttttattcgtcactttcacatccaaaaatatataatcttcattaagcattccgttactacctccttgctacaactatagtctatctcgaatctaaatttatttcaatcaatgctatttccacttattaacggaaacttttactttataaacatcaagatttccaaaataaaatggaaatcaattatttgcaatcaaaaataattatctatacaatatagacataataaggaaggaatcgtgataatgatgtttccatacaatcgtttaaatgaaatatttgactatgtcagacaagataatatagtatctgcaagtcagttatcagttctattaaacatcacagatagaacgatccgtagtgatattcaggcaattaatgaaattcttgaaaaaaatggagcaaaaataaaattaaaaagaaaagctggatattatattgagatcaatgatcaagaaaaatataatacttttttatgctcaataaaacaaacaagaactagtaatttagaattagacagttctcaagatcggattaaatatttattaaatttattattatatagtgatgaatatatgagtctagatgatttggctgataatatctatgtgagtaaaaatacgttacaaaactatattaaaactttaaaagctattttttcaaaatataatcttgaatatatctcaaaaactaatgtcggggtcaaaataattggtaatgaagatgataaacgcaaatgtctagttgaaaatgttttatcgtacaactttcaaaactatgttaccggctttacaaaagatgaatatactctttttgagggaattgatctagatcttcttaaacaaattatctctaataaattaaaaaatgcacatataaaaacaaatgattttaattttaaaaacctaatcatccattttgctttaatgatctcaagaattcaatttgactgttatatcaatacgaacaatactattaaaattgatgataattatactgattttattgatgatattgcaaatgaaattgagtatacttttaatattacgattagtgaaggtgaaaaaaaatatatttattcacatttagtagccaatacacaattaaacgacttagtcgataatgataataaaatcaaggagttagtagaagaattattgaataatatatattttgattataattttgatttgcgtaatgatgaaattttgtcacatgacctctttttacattttaaatctatcttaaatactaaatcatttgcgttaaataaacgaaatccattattaaataccattaaaactaattttcctttagcatttgatattactttaacgtgtaccgcaaaaatctttaataagccaccctatattttaactgaagatgaagttggttatgtttctttgcatatcggagctgcgattgagcgttgtttttcaggaagccttcaaaacaaaagtgttattttagtctgtggttctggtcaagctacaacaagaatgttagaagctagattaaatgttttctttaaagataagataacaattgttcgtaaagcttcatataacgaatttattaattatacaaaaagagaattattgaatattgactttgttatttctacaataccattaaagagtgaacatattcctaccattactgttgactttgctttaaataatcaagatatcgaagcaatctctaaatttctaacatcaatttctttaaataaaatgaagaaatcaaataaattttttgataaaaacctctttattcatttagatggaatagactctaaagaatctttattaaaacaaatgtgtcaattaatggaaaaacaaaatattgttgatagcaattattttgattgtgttatggaacgtgaaaatttagcaaaaactaatatgaatgaagtatttgcattaccacatcctatgcgcctatgtgctaaagatactaaagttgctgttgctatcatcgataaaccattaacctggtatcaacaagatacggttcagattatctttttactagcaataaaacaaggtgaccaacaagacattgagcacctttatgatatctttattgaaattgttaataatgctaagttacagcaaagtattattcatagttataattatgatagttttattaataatttattagagaatatggagtaatcttattaagactcaaacatcgacctattttggtgtttgagttttttatttataaaatcttttgcatttcctcaattaaaactttacgggttggatatttatcaactatttgtataaaaatactattacgttaaaacgtaacaactctattgcaacactattttttaataaaaattgtaataacatatatcatttattaaaaacttttcctgataatgaaattatggaactcgatgaagagctgttaaaaagtttaggtaataaaatatgggaatttgatggtgtttataaaaattggaacacatataacgaacttattgataaaattccttatacaaatcaccacacaaatattgtttttagtatatttaatattaataaagatttttcattattagaaatagtagacttttttaaatcactggaacaaaaaggttacaataatgaaaacatgtattttatcattagtttatgtaatgataacattaataagtatgctttattatacactatctaaatataaagaaagtacacatattaatattttatatctcttttctttaaataaaatcctattgttgatataatagcttctaggagtgtgaattaaatgaaaacagtaaaagtagtagctgcgattataaaaaaagataacaaaatactaattgccagtagaaaaaaaggggagtttgctggcatgtttgaatttcctggaggaaaaattgaacctggagaatctggagaacaagctcttattagagaaattcaagaagaactagaaacaacaattattattgaagaattttttatgaatgtgaattataaatatccaacatttatcttagatatggattgctatttatgtactttaaaagataatcatattaaactaaatgaccataacagtataagatggatttcattagatgaacaaaatattaattggattcccgccgacatacaaatatttgatacattaaaaaaacgaggaattttacatgacactaacaattgattatcataaaaatttaaatgcgctaaatacagttgataaaacataccaaccccaattgttgtttaatgattataaacaaggtatgaaactatctcatgaacttgtacaacaactaaactcttgtgatagttttgaattatcaattgcctttatcagcatgtcaggacttgcaacaatcaaacaaactttattagatttggaagaaaagaatattcctggaaaaataattacttccacgtatctaggatttaatgagccccgtacgtttcaagaattacttaaatttaaaaatttagatgttagaatttatgatgatgaaaaggctggttttcatccaaaaggatatattttcaaaaaggaaaatacttttaatattattgtaggaagttcaaatttaacccaatctgctttatcaataaaccaagaatggaacttaaagttttcatcgaccaataatacaaatattgttgaacaaataaaaaaagaatttaatcaacaatgggaaaactctatttctttaacaaatgattggattgaagaatataaaaaaaattatgttaaacctattaaatcagttactaatattataaaaaaagaaataaaacctaataaaatgcaacgagctgcattagattcattaaaatcaattagaaacgaaaataaaaataaggctttacttatttctgcaaccggtacaggcaaaacatttttaagtgcttttgatgtgaaaaatgttaatcccaaaagaatgttatttgttgtccatcgagaaaatattgctagaacagcaatgttgtcatttgaaaaaataataaataatcatagtttcggtgtattcacaggtaacaataaagatattaatgctgattatatattttcgacaatccagacaattcataaaaaagaatatcgtgaaatgtttaatccaaatgattttgattatatcattattgatgaagttcaccgtgctggagctaattcataccaagagttagtaaactatttcacccctaaattcatgttaggtatgtctgcaacaccagagcgtagtgatgatttcgatatttataaaatgtttgattataacattgcgtatgaaattagactacaacaagcaatggaatatgacttattatgtccctttcattattatggtattacagatattcaagttaatggagaatcactggatgataaaacagattttaacaatcttgtttccaaagaccgagttaagcatataatagaacaaataaatcgttatggatattcaggcgatcgtgttcggggattagttttttgtagtcgtaaagatgaagcaacggaactatctaacttattcaatacccgtggttacaagactatatctttaaccggtgaaaatactgaagcacaacgccgtgatgcgatgaacagacttgaaagtgatgatttagttaattgcttagattatatttttacagtagatatatttaatgaaggaattgatattcctaaagttaatcaagttatcatgctacgtccaactgaatcagcaattgtttttgttcaacagctaggacgtggtctacgtaaagatccttctaaagaatatgttgttattattgattttattggaaattatgaaaagaactttttgattcctattgcattaagcggtagtctaagctataacaaagatactttaagaagattcgtaagtgaaggttctttaattattccaggtgcatcaacagttaattttgatttgatttctaaaaagaaaatttttgaatcgattgataaagcaaattttagtgatattaaaatcattaaggaaagttatcaacaattaaaacaaaaactaggtaaaattcctagtttaaaagattttgataaatatgaatctattgatgtcttaagaatttttcaaaataaaaatttaggttcatatcataaattcctaacaaaatacgaaaaagaatataatgttaaattcagctctgttcaagaacaatatcttacttatatctcaaccaaacttgcatcaggaaaacgaattcatgaattagaagcaattaaaattgcaattgaaaaacatactaatttacttgataatttaaaagaatctttgttgaataactataatcttaatttacctaaaataacttatcagacaatcattaatattctaagtcaaaattttgctactggctcatcaaaagcaacatttaaagatgctatatttattgatgaaaacctcaatacttctgcacaatttaaaatgttattagctgatcaagaatttaaaaaacaaataattgaattactcgattttggaataaatcgttataaacaaaattatacgaatacatataaagatacctcactatgcctatataaaaaatacacttatgaagatgtttgccgcttattaaattgggaaaaaaatttagttccacttaatataggtggatataagtacgataaacataccaacacttttcctgtgtttattaattatgataaagaagaaggcattagcgaatctatcaaatacgaggatagattagtagatcaaaatactataatttgtttttctaagccaaggcgtacgattgaatccgaagatgtagttaaaatatatagtgaaaaaactaatcatgttaaaatccatctatttattagaaaaaataaagatgatgaagcctctaaagaattttactatttaggtctaatgcacgcttatggcgaaccaattcaaacaactatgtccaatacaaacaataatgttgttcaatttacttataaattggaaaatgagataagaaaagatatttacgactatataacaaataacgattagatcaaataaaatctaatcgttattttacataactacattacatttaaaattacacttgaaaataggcttatgactaaagaaataatattaaattaatgataaatttaatattattaaaaaaatcttccttgcttcaatctcatcataatcatttgaaagcattttgattaattgatgatatttatttaatcacatatttactctttcaatttttaaaaactccctaatatattttttataaattttcatagtttcattttatttttccattattatatcatctatgtataatttgcttatataatctttatttcacgcaatgacaattattaaaattactttgaaaattacacaacaacaaaattaaaagtaaagattgatttttatactttcataaaaaatagaataattatatgaaatttttactagacaatacctaaaacagctatataaaaagttcgctaatataacgaacttttatatttttataaagacattcccgcatagaatccatcacgtatagcattagcaaccttaccaattttttcactatccccaacaattcttgttttagttggataaatatttctaatttcttcagctaattcacgatttggtttcattccaaatgctctaataatcgtatccgctttacaaacaacttcttgttcatctttttgataagtaatgccatcattattaaactcaataactttagcaccggtaatcacattaattttatattcatcaatctttgcaaaaattgaagcctggttaataaataatacatctttagcaatactatcagccatctcaattattgtaacatttttaccatgttcactagcaagttcaatggcactatcaatacctgacaatcccccaccacacataatgacattttcacctttaaccatacctttgtgcatatgtgcgtcaattacactaattacattctcattattgataccatttattggaggtataatttcatctgctccacaggccacaataatttgatctgcattttttaaaatttgatcatctgcttttacttcataattaaagtgtattattacatccaatttatttaattgtacttcaaaccatttaactaatttctttaattgatccttaaattttggtgtcgcagcaacacttaattgtccaccaatcatattagtcttttcataaatttccacattatgtccttcagcagcagctactctagcagcttctaatccagcaggtcctgcaccaatcacaacaatattttttacttgactacatggcttaattgcaaaacgttcttcttcacatgcttgaggatttactgcacaactcaacttagtaagacgtccgacaattctccctacacattcttcattgcagcgaatacatgggcgaacatcctcttcatgatcattcattaatttatttactgtatctggatccgcaataaattgacgaccaaacataacaaagtcagcatctttagattcaattaatcgaagtgctgattcaggtgtatgatttccagcattcatgatcggaatatttacatgtttgcgcgcttctttgcatacataatccatacaagcatcacctaaatatgcagttgggaaaatataatcaatccgttcataacatcctgcgtcaatatctaaagcatctaccccagctttttctaaaatctcaattaattccatactttcatccaaggttctaccctctgcaaatagatgatctaaagcaattctaaatataactggtaaatcaactgcctgttttatagattgcacaatttctgtagcaaaacgcattctattttcagcactaccaccatattcatcagttcgcttattccatacaggcgacatgaattgatcaaccaaatagcccgcatgtccatgaatttctattgcatcaaaaccagcgtttttagcaattattgcgctattagcaaactctgtcataatttttttaatatcttctttactcaatggacgacacttcatttcaggattaaatgttgatggtgtatcacttgaagagaatggtggttctccatacatgttaggaaaagcatttcttccagttccacaactaatttgacaacaaatttttgccccccaacgatgtgtcgcttcaactacagttgtcaattgaggaataacgtaactattttgtaagactccttctaatgatccttgtgctaaatcaggatttaaaaattgacatcccataatgatcaatccaaccccacctttagctcgcgcttcaaaataatcaatttcatcattagcaatacatccatcaatatgtgaagaattagttcccattggtgccataacaaaacgatttttcacttccatattacctattttaaaaggtgtaaataatgcatcgtatttcatataaattacctccgtcgatatttaaattttatctttcttgttaaaaaaataccatgggcaaaaatacaaatatttaattactggttgtgcaaattgcacaactacatttataatataaaggaggtgagcttatgaaagatatgtatgaatttctattcaatggattaataaatcataatctgcatcagtttatgaaacaattatacgaatatttccatcatccaatggtcttatgtgatgtgaattatgtagttttggcacaacatccaaatcaacaaattggagatatgctctttgatcacatgcaagaacatcaaaaagtagcagttgagatgctcccatttatccaattaggtaattatcaaaaagatttggatcaaaataataatgttatctatgtcgattacggagttgggcagacaattccacgaattattgcagcaataacagacaatgataatattattggttacttatgcattttatttgcagatggcaagccatcatctgaaatattcagttttatcagtaaattagctaaaactatcgcatctattatttgtcacagcaaaaccggctataattataatcgttacgaatattttgcaataatgaattacttattctcaaatgacaatataaataaacatgatttagaaaaattattacctgcacaacccaataattttagcagagattactgtattattactacaaaggtaggcttaaaaagcaatgagatagtgtatttaaatcaacttcatcagcatattattactttaccaaatacatattcttatctccaagataactgcttatatattttaattaccgggcttaatagagcaacaaaaaacaatattattaataaagtaaaaagtttaataactgctgtaaatatttataaattaaagtttggtattagttatattttcgataatctgttagatattaatatttataaacaacaagcactgaaagcttacgatttaagtaaacagcaatttactttttttgaagatattgctttagaatcattttttactactagttcatacaagatatatctccatccacttattacaaaactaaaacaaattgatgaatcaactaagaatgattattatcatactttaaaatcgtatatttgtaattttggtgactctcataaaacaattgaacaattggctatccaccgcaatacactactttatcgtttagaaaagatcaaggaacttaccaatgttgatttacatgatgagaaattatgcacattgctgctaatcagtttttttcttgctgaaaacaattaaatcattatcagcataaagtttgttaatttatttcaatattttggtataataacaattgagctgctctattaaataagcccaaatatgatagtcgtatatagaagtagattagctaagatgattatagaatcaaatttttctttatcgacaaaagtcttaacagttaagataagattatcacatctatcaggattgttagggaagttatattaaaaatgtcctgattaaagttcattgcataaacttgattgttttgagttgattcatcaatatctacatagagtgtattcataaaatcagcacctttcaattgaaatataactaaaaataaatacttgactaacctctgttctttagatatgtcataatctcgccataagaataaaacaatattaatcaaggctacgcatcaaaatatattgaataaacaatattcgatgaggtaattcattctaaaattgaaagacggactcattaagtagaatgcagcaaggtgaaaaagaatattattacttaggaaaatccaatatgaaattaagattgtaaaggtgctgtaatctttacaaaatatattatacgaggtgatagaaaatgaaagaatgggatttatcgaaattatatcaatcatttgatgattctagttttactactgattttaaccaaatcattaaattacaaaaacaaataaatacatatcgtaataacaatgatgaaaaatcattagaaaattatttagtcgatttaataaaattaaatcaactaattgaaaaagtagctaattatattagtttaactttatcagtcgatacaacaaatagcattgctttaaaatatagcgatcagctagataaccttttagcttcttttgttgaagatgaagtcttaaatcaacaatggatcagtacttttaagcttgattcattaaaatcaaacttaatcaaggaacatctatttattttaaaagaaattcagcaaaatcaaaaatacactttagataaaaagagtgagagcatcattgcacacatgcaaaatactggtagtaatgcttttagcaaactaaaagatcaattaatttcatcaattgaagtaactatcgaggaccaaacctaccctctaacttcggttttaaatatggcctatgataaggatcgcgaaatacgtaaaaaagcttaccaagcagaaataaacagttatcaagataaagaacaggctattgctgcttgtttaaacggaatcaaaggagaagtactctatactactaaattaagagggtatgaaaatgaactagaaagaacccttatcaatgcacgaatgtcaaaagaaacattagatgttttattaactgtgatgcaagaaaaccttagtgtctttagggattatctaaaaactaaagctactgcccttggatatcaaaacggattaccttggtttgagctttatgcccctgttatcgaagatcatgacagtcatccatacgaaaaaagctgccaatttattattaatcaatttagtaccttttctgaacatttaggtacttttgcgaaaaaagcaattgaaaataattggattgatgtttatccccaaagcggtaaagttggcggagccttttgttgcaatcttcatagtatcaaggaaagtcgttttttattaaattatggtgacagcttttctgatgcaattacgatggctcacgagctaggtcatggctttcatggtgaatgtttaaatgatgaatctattttaaatagtgactatcctatgccaattgcggagactgcttcaactttttgcgaaacaattgtaactaaagctgctttaaaaaaagctaatgatcagacgaaactaagcttattagaagatgaattatcaggagctacccaagtaatcgtcgatatctactctagatacttatttgaaagtcgtttttttgaaaaaagagaaactggtgctttgtcagtagaagagatcaaagaactaatgattcaggctcaaaaagatgcttatggagatggtttagatcatcaatatcttcatccatatatgtggacctggaaaccacactattattatgcagattgttctttttataattttccttatgctttcggtcttcttttagctaaaggattatacactatttaccaaaaagaaggttcaaaatttagcaatacttatgaaaaattattatccttaacagggaaaatgtcattagaagatgtttgttcaagtgttaatattaatttaaaagataagtcattctggcaagcatcaatcaatacttttaaagaagatctcaccttatataaacaattattaaataaagatgttatatcacaataaagagatataacatctttttactttataaagtatctaataaaaacaattaacttatcaaatcaattactttatattataaaagtttattgtttagaagcttttattttaagcttttttgaatttcgtgattaaattcacttttccaatccgttggataagttcttgtattttttaaaagctcttctacaaaatcagcaacatcatctccagttatttctaaaactgatcttcgtactgctgcccttcttcaaataattcaagtaaccccattgaatttcaagcatatcatatcctgacccggatacaaactgccacatatatgcttgaattttttttaaacacactgctaatcagccggtaattgctctacccttttcatatgcgttcgatattcctttttactttttatcattattttaatattaaaataatcatcaaaaaatttattcatttttaccactctcctttaattcattaagtttatcagtcataaattcccattttgtccaaaagagtcgtaatttttcacgtccactttcatttaaagaataaaattttcttggaggtcccattttagacaactttttttgaatcttaactaatccactcttttcaagcctaactaatatagtataaactgttccttccacaacctctgtaaatcctaactgattgagtcgtcttgtaatctcatatccatatgtttcttcttgattaattatttctaaaacacagccttctaatattccttttaatatctctgttatatccttcaagtcaactactcctccctacttataagtccatgtattcagtaatgctaagtactgctatataataaatagtagtatgtctatcaatataaattagtgagtatagcatctaaaaataatctttttagtattataaaattagcttcttttataagtaaagaagcatctatcactatatcttgccattatcatgatataatatatttatcaaaataaaggagctgaaattatgaatgctaaagatatcttaactcattatcaaaattttgcagtaatcggtgtaacgacaaatcctgataaatttggctacaagatttatcaacgtttaaatgaaatagaaaaaactgtgtatggggtttcacctatttataaagaaattgatggaaagtcaacttttcccaatctaactgccattaaaaataaaattgacgttgctgtgtttgttgttagtccaaaatttggaatagattatattaaagaatgtaaccagcttaatatcaaacatatctggttacagccaggtacttataatgatgatttgatttctttgattaatgaaaataatcttaattattatcaaaattgtgttttaatagaaagtcaagatttataaaatcagttttaaactgattttttgtttaacttaatattaatttcatttgcaatggctataatattaataggaggtttatatgaaaaaaatatattataatggtgatattctaacgatggaaaatagtgattatgaagctatttatgtagaagatggtgtgattaaaaaatgtggtaattattctgaaataaaaaatctagtctgtgctgatactgagttcattgatttacaaggaaaatgtttaatgccctcttttattgatagtcatagtcatgttgtttctttagcaagtacacttaaacttgttgatttaagtaaagcaacaagtattgctcaaattattcaatgttttaaaaattatattgaagaaaataatcctacttcagaagaaatgttaataggttttggctatgatcataattttctcaaagaacaatgccatcctactgcaagtgatttagataaaatttctaccactaatccaattatgatggctcatgcatcaggtcatatgggtgtagtcaatactaaaacaatgcagctactaggactaactgatcaaattaacgatcctgttggtggtaaatacggacgtgatgaggatggtcatttaaatggttatcttgaggaacaagcttttattacgattgcaagccaaggaagcaaggaaaataaaaatttaaaaacacaaatccttgatgccttaaaaatctatgctagctatggaatcacaactgtgcaagagggatatatgaaacagcatgaatttgatttattgaactctttggcgacagaaaataaattatttctcgatgttgtaggttatgttgatattaaaaataattattctttatatcgggataatcaacaatatcatcattacttaaatcattttaaactaggcggttataagttatttctagatggttctccacaaggaaaaaccgcctggttatctaagccatatgaaaatagtggtgactattgtggatatccgatctacttagattcagatgttaaaaaattcgtagatatggctattaatgataaagcgcaactactaactcattgtaacggtgatgctgcttccaatcaactacttgatgcctttaatgatcagtacacacctctacgccctgtaatgattcatagtcaaaccttaagaccagatcaactaccgcggctaaaaagcattggaatgattcctagtttcttcattgctcatatctattattggggtgatattcaccgccgtaatcttggacaacgtgctgaatctatttcttgtgttcatagtgctttaaaattagatttaccttataccttccatcaagatacccctgttattgagccaaacatgttagaaacgatttggtgtgctgtaaaacgccaaaccaaaaacggggttactttggggacagatgaacaaatatctgtctacaacgcattaaaaggagtaacaattaatgccgcttatcaatattttgaagaacacttgaaagggtctattaaagaaggaaaaaaagctgatcttttaatccttgatcgtaatccttgcaaagttgcaatcgaggaaattcgtcagattaagatcattgagacaattaaagatggtattacaatatataaaaaagatatctaaacgtagatatcttttttaataccgaaattacgaatgccctttatgaccaaataaggccataataattgcaattattcgtgccatattttatcccttctttacttatttatatttatatcataacactattgatctaatttaactcagcattaacaaaatcataacaaaaacatcctatttagtgccatttaattgacttttatagacaaattttattataatgaaaaggcatgaaaatttaataataggagataaaaatggaaacaaaacacaagcgaagtagcttttctggtcgcctgggctatgttatggcagtagctggttctgctgtcgggctcgggaatatttggcgtttcccttatttagcagctaaatatggtggaggtacttttttattcacatattttattttagcgattacctttggttttgctttgctaattagtgaaactgccttgggaagaaaaacaaaaaagagcccgattgcagcctataaacaattgggtgcaaaaaaacttcaatttggtggttggctaaatgccatcgtgccaatgctcatcgtaccttactactgtgttgttgggggatgggtttgtaaatatttatttgaatttattacaaacaattctgccagcttagttagtgatacctattttactggtttttcatcttcaacactacagcctgtcatctggttacttgtctttgctggaatggtatttggcgtagttatgctaggtgttgaaaaaggaattgaaaaatgcagtaaagtattaatgcctgctttagttgcaatggctctattcattgctttatatgcattatttacacctggtgctattgaaggggttaaatactatttaattcctgacttctcgcgtttttcaatcatgacagtagtagcggctatgggacaaatgttctattcgttgtctatcgggatgggaattttatttacatatggttcatatatgaaacgtgaaattgatatggaacaatcaattactcaagtagagataatggatacattaattgcctttctagcaggtttaatgattatccccgcagtatttgctttttctggtggaaatccagatacactaaacgccggtccttccttaatgtttattacaatgccaaaagtatttgccagtatgtcatttggtaacattattggattagtattctttttattagtactgttcgcagcattaacttcagcaatttcattaatggaatgttgtgtttcaattattcaagatcgatatgatttttcaagaaaaaaatgctgtgttcttatttttggaggaattgctttattaggtattccatgttcacttggatttggtgttttagatttcattacaccgcttggtttaagtattcttgatttctttgattttatgacaaactcaatcatgatgccaatttctgcagcttgtacatgtctacttatcatcaaagtaaccggttttaaaacagttactgacgaagttgaatacagttctaaattcaagcgtaaaaaagcttatctattttgtatgaaatatgttgttgtccctggcctattaataatattaattagttcagtcttatcaacaatggggattatttcaatttaaaaaaacaagtaatgaaataaatcattacttgttttttattttattgtacgctacacatgcaaagaaaaatacggttattcctaaaagagtaagaaatgataataatgtaactggtgccattgacacaatctcctttaacatatcttataaatctatttctaatccaacggggcaatgatcactgcccaaaatatcagtacaaataaacgcttcttttatcccttcttttaaacaatctgaaacaataaaataatcaatccgccatccagcattattcttacgggcattaaatcgatatgaccaccaagaataaacaccttcttgatcaggatataaatatcgatacgtatctataaaaccattttctaataaatttgtcatcttagctctctcttcatcagaaaaacctgcatttttacgattcgttttaggattctttaaatcaatttcttgatgggctacatttaaatcaccacataaaataaccggtttactcttctccaaagacttcaagtatgcaagaaaatcatcttcccaatgcatccgatagtccaatcgtttcaattcattttggctattaggagtataacaattgactaaataaaatttttcatactcaagcgtaacaacgcggccttcatggtcatgttcttcgataccaattccataactataatttaatggtttttctttagaaaacactaaagttccactataaccctttttttcagcactattcatataagtataatatccatgcttttctaattcaatttgaccttcttgcatctttgtttcttggacacaaaaaatatctgctttactttcttttaaaacatcatagaacccttttgtaatacaggctctaattccattaacattccatgatactaatttcattctcttacctcactctattattatacatgaaagcgcttttctatagaagtgtttttttctatattagaaaaaaatttatcattctttatcacttcttaagatttttaatattttccgataatctgtctatactaatataggtgataaaattgaaaaaatacaaatatattatattaaatctatcaatctctctgggaatcggtgctttaagtgcaatttttacaatgaatgcaatggatgtataccaaacagttaaccttcctaagtgctctccgcctggatatctattcccaatcgtttggacatttctttatattttaatcggtttagcaagttatctaattcatcgaagtaatagtaaaaataaagaaactgctcttattatttattattttcaactactgattaattttgcatggcctatcgctttttttaattaccaaagttttttattagcactagcaatattgattacactatgtattctagttgctattcttatcaaattattttatcaaatccgtcctttagcagcttttttattacttccttacatgggttggatactttttgccttatatttaaatttttggatttttgtaaataattaaagtcttgaatattatattagaaatagttgccgagaaactaagtttatttttttaaagtaagtttccattgacaattactttgctttgtcaaattggacacttgatataattgaatagctattaggaaaaaataatattattctctaatatcaaatgattaataaaataagaaatatagtaattataaatgttactacttttggtaaattaataaacaagattacttagatagtaaaaaatcaaaatagttgattacatttttatactaacgaagcacaggtttaattgcaacgattgaccttgtcactcaaattgctttattaccgagctgattgaatcaattcaaaactagaaagtattgaaaaataatcttagtcagcaaggggctaacccacatatattattaataaaactttaaattaaatcatatttattaaataataaaagatacttgataaactattacttaaaatagttcacaagtatcttttcactatattaaagcaaaatatactacgaagattaaaattaaagcccaaacaatcggtttgatttctttagatctaccagcaattacactagtaataccataaacaataaaaccaaatgcaatcccatctgaaattgaataagttaaaatcatcatgatcactgtgatgaaaccagatgcagcgaaaacgatatcatcccaatcaattccacctaattgagttgccatggaaattccaactgccactaaagcaggagcagtaaccgcactagttacaacactaagtactggagcaaataaaattgataagaagaataatattgctgtagtacaagcagttaatcctgttcttcctccagcttcaaccccagctgttgattcaacaaaagaagtaacagtagaggttcctagaattcctccaataactgttcctgtagaatcagcaactaatgcttgttcaatattatctaactcaccattttcatcaactaaattagttttgttcgcaactgaaattaatgttcctgcggtatcaaaaaaatcaacaaataacaatgaaaataatgctacaatacaatccggatggctaaataactcaccaaaaccattcataaatataccaaacccactagtatctaaatcaattgaaacaatttttgaaggcattgccggcattccctcgataccacataaaccagctacaattccaacaattgcggtaatcaccaatccataaaatactgctgctggtgtcttacgagccattaagataattgttattaagaccccaaatactgctaataatacaactggatcagtcaacttccctaacgccacaaatgttgattcgcttccaataatgattccagcattttttagtccaataaaggcgataaaaaatccaattccagctccaatcgcaagctttaattgttgaggaattgcattaataattgctttacgcaccccagtaactgaaattaacaagaaaattattcctgatactacaaccgctgccaatgctgctgcaggactataccccattgaaaaaacaagggtatatgtaaataatgcattaactcccatccccggtgctaaagcaactggatagttggctaataaccccatgatcaaagttgcgatccctgaagatagtgccgttgctaagaaaacgccatcataagacagcccagtctcacttaacatgttcgggttaacagctaaaatataagccattgctaaaaacgtagtaattccagcaataacctctgttttgaccgttgttcccttttcttttaatttaaaaatcttttcaagcattgtctttctcctttttaaaaatacctttttattatatctaaaataccagtcttttcaaggaaaaagcgctaatatatgacaattatgaaatatttacataaaataatatttcttccaaggctcttgtttttaaacgataataagttgctcgactataaaattcaagccaccactcatgattcttctgtaaaacaaattcatttgtaataattaattgactctcaggacttaatgcttgaatcacaatttcaaatgctgccaccactcgctccaattcatctctatcatcaattcgttgatttaagcgttcagcaattgaagcattatatccacttttcttttcatgaagcatcccgatatttaactgcggatagaaattagtattttctaaacaatacaatttcaatttagctcggtgaaactgcttaaacagctccgctactgcttcttgtttttgtttaaatgtcagtttatttgtttttctcataaaaaaatcctcctattatcatatacaactcaaataggagaattactttttttaaattacaaaattttctataatttcaataatcttttcttcttcaagaccgcaacttaccaaatactctttagcacttccataatgttctctcaaatagtccaaaaatttcatcatcatttgtggagcagattctaaaaatgcgcgattagcatcatcaaccaaacgttccaattcagaaattattttaagattattttcatatgattctgaataatctttaacaatatcataatcatgacaacctgctaaatctaacaataatgccgcaatcaccccagtacgatcttttccagctgaacaattaaacataattgcatcgtatggatgatcataaaacaattcaaaaacttctttaaactgctgtttatttgcctctagcataaaaatataaaaaccagctaaatcttgataatttgttacttcactagggagaacatttaaatctttagactgcattaaattgacattatagtattcaatatcacgataacccgttaattgacttggtaactgttcgacttcaaagtcacttcgtaaatctacttgcattctaattccataatcataaagatattctttctcatcatctgataacttacttggattggttgaacgaataaatttatgactttttgtataaaaaccagtttgagtttcatagccacccaaatcacgaacattagtcatactttttacatctaacattctttcttcacgacttaattgcatcattttataattacctcactgttataaattctatcataattataatcttgatacaatttattattcttcaaacggccgaactcttaactctactccaagaccatcggcaattttttgacacaatttaattttttccaccccgattatatctacaactgtcaaaacaacacttggtacatattttttacacgcttttgtgaattggagcatgtagttaaatgaatcaactccataacaggctcttgttaattcataatattcttccttagttggagcatttaaacttatagatactgtatcgattactcccttaaaatcaggcgcaatatcacgccctaacgtaattgatgataagccatttgtattgattctaatcgataaatctgaccttttctctttaatatattttgcaactttcattaaatcatcgtggcgagttaacggttcaccaaaaccacaaaatactacttctttaaatgctgttaaatcatatttttcaaattccgcaataatcatctctacagtcggctccctttttaaccatagagaatttgattcaagcatttcttttgtattacgtaaacaaaaagtacatgcacaactacatctgtttgtgctgttaacataacaagttattcccttatacgtatctagatcttttaaatcaatatatccattaccatgtagcgtatataaaatcaccattttctttcctcctaaagttcttttaagaaaggctcaaagcatagtcccaaatgattatgagctccaactgcttgactatactcaatacacctagatgcaaaatttgcagctttttcaacacattgatagaaattcaaaccatttaaataacttcccgcaataacaccgctgataacatcaccagtcccgcttcgatcatcgcctattcgctttactttgataatggcaggttccttcccttgttcatatgcaaagttaataatttcgtcaccaatactaatccctgttacaacgaccatttgtgggcccaaatttgacaattggcgacacatttcaatcagctcatcccgattaattatatcatgcggatatggtacctctaaaagtgcgcataattcagttaaattgggtgtcataattgtcgcatatggtattagttgacgcattttatcttgcattgcagtagtataagtcggataaagtttcccatgatcacccattaccggatctactaatacaaatgtatgttttttcttaaaagtttttataaaatcaatgacaatatcgatttgtctttctgaaccaagaaatcctgtagcaattccatcaaaactaaccttcatttttttatatgtttcaatataatcattcattcgatccgtataatcatcgaaataatattctggatgcattgtgtttactgataggattgcagttggaacaaaaacacattcaattcccattgctgaaattatcggcagctgcgctgcaatcgaacatctactatatcctgttacatcatttattaaagcaattcttttcatctcattttatccccttatcattgtcattcattttatcacatttttatattttttaaccatgacagttttgattatttttatatggacaatcccacccactattttgtataataaataatagatagatataaggagataatatgaagaaattatttaaatttacaatggttatgctattagcattaagcttagccggatgtggtggaaaaagtaatgatgaacaagataagaaaacagcatccaaagatttgttaagcggtaattatcgaatcgaaatcgatgttaaggattatggagtaatcaaagttgaacttcaagctgatgaagcacctattactgtaactaattttgtaaaactagttaaagaaggtttctatgatgggttgaccttccatcggatcattgacggctttatgattcaagggggtgacccaaaagggaatggaactggtggttctgacgaaacaatcaaaggtgaatttagttctaacggtgttgaaaatcctttaaaacatactcgcggtgcaatctcaatggcgcgttcatctgatcctgatagtgcaagttcacaattttttattatgcatcaaacaactacttcactagatggggattatgctgtttttggttatgtttatgaaggaatcgaggtagttgacaaaattgctacaactgttccagtaactgataataatggaactgttgaagcttctaaccagcctgtaattacttcaattaaaatgttaaaataatcaggcatgtaagtcatggatttctatccatggcttttttatctgatgagaatttaatgtcgattttaggaaataatgctaataaagttattattttttaataaaaaataaattactctatgaataatccattttttatttcatgtcttattctatagagtagaaatctttttactttagctttttgattgcttttataaaacagaaaattgtaattacaaacgctcctaaatcagcaattggaacagcccagaaaataccattcaaaccaaagaaagtcgctaacaataaaatcattggaatcaaaataattacttgacgaagtaaatttaaaatacttgctactttaattttaccaatacattggaaataattagcagtcatgatttgagcccctaacaatggtaaaaataagaaccaaattcgaattgcctttgtgcctagttttacaacttctgcctcaccattaaacattctaattatagtttccgggaaaaattgtactgctaaaaaacctacaactgcaatcattgtaccaccgataatcgcatattttaaagtttctttaactcgatgataattgcctgccccaaaattataactaatcaatggttgttgcccttgcattaaacctgttaaaggcatctggcatatagtttggaaactagtaatgattcctactgttgaaattgcgatatcaccaccatacattcctaatgtactattcaaaataaagtttaaaacactattagccatttgcattaaaaatgctggtattcccgttttaataatatctaacgcatagatcagctttagtttcatatgttcgatatctaacttaatcaaagagcgatttgaacatagatagcacagttgccaaatcatacttaagaattgtccaccaattgtcgctatagctgcaccactcattcccatatgcaactgaatgattaaaatataatcaaaaacgatattaaatccggcccctattaattgtgaaatcattgcattcttagggttgccttgtgcccgagaaaaattattcccacacattgcaacacactgaaatactgctccatacaaaacaattgataagtaatcgctggcatatggcaaaactgttttactagcacctaaaacttctaacatgggtgttataaaaatattccctaatacagtaaacatcagcccaaaaacaactgttaaaacaattgcattaccctgatagattgaagccttatctttctctttttgtcctaaagaaatgctgaaacgagtagctccacctactcctaccattaatgaaattgccattaatactaatgtaactggataacttattgtaattccagcaatccctaccgctcctaattgtggcgcatttccaataaacattcgatcaaccacattataaattgcattaactagcatcccaataattgctggaacactaaattctattaataatggaaggatttttttatttcccattctctcatcattcatttattttacctccttttagatttgtttgtatcacatctaacattcttcgaagttcttcttgttctttttcactcaacccagatactaaaataaaatcttttttagcaaatgtctggtcaactatctgctgtttttcttgacctaaggctgtcatctccaataaataaaaacgtttatcaacaggcgattgaattcgtttgattaaccctttattttccatattttggagcaatcttgttacagcacttttatcaatttgtaattctttaatcaattcttcttgataaaccttactatgacgactcaaaaacattaggacagaaccttcattacttgttaatccatactcttttaatctttgattactatcatttcgatttaatattgctaaatgatgaataatccgtccaattctttccattttgcacctccattagttgatatgtcaactattataccaacattagttgatatgtcaactaacaacaaaaaagatacgaaaatttcgtatcttaatatgcttttgcaaaatacacaacctttttagctggtttaccacaaataggacaaacatcaccaaatgcttcttcctcttctttaatacatcggctggttgctccagtttcttctttgattttaacttcacaagcctcatcaccgcaccacatcattttgatataaccgcctttagtttccaatgtagttttaaattcatcatatgtgttaacttgacgaatatttgaattgcgatgatttaatgctttttgatacatttcatcatgaattgtgtctaaaagggtttcaattgtattaattagttcttgatctaatgcatacttctctttagttccatcattacgttttgcaattacacaagcattattttctatatccttaggaccaatttctaatcttaatggtacgccacgcatctctgcttccgagaacttccatcctggtgatttatcacttgcatcaactttaactcttattccagcttcttttagctgtttttcaatttcataagctttatctaaaacccctgctttttgttgttgaattggaataatcattacttgagtcggtgccacccgtggcggtaaaactaaaccattattatcaccatgaaccatgataattgctcctaacaatcttgttgaaactccccaagatgtttgataaacatattctaatttattttcttttgataaaaatttcatatcaaacgctttagcaaaaccttgtccaaaataatgactagtgcctgactgtaaagctttaccatcatgcattagtgcttcaatcgtataagtttcttcagctcctgcaaatttttcacgttcagttttccgtcccgttagcattgggattgctaataagtttttagcagtatcttcatagatttctaacatttgcaatgtttcagcccgagcttctgtttcactcgcatgaacagtatgaccttcttgccataaaaattcagatcctcttaaaaatggtcttgtcgttttttcccaacgtactaccgaacaccattgattatataattttggtaaatcacgatatgaattaactattttagcataatgctcacaaaaaagtgtttctgaagtaggacgaatgatcaaattttcttctagatcatctaacccacctttcgttactattgcgcattctggtgcaaatccttcaacgtgatcagattctttttgtaataatgattgtggaataagcatcggcatataaacattctcatgtcctgtttctttaaaacgtttatccatgtattgttggattgcttcccacatcgcataactatatggtcgatagataataaatccttttacgctgctgtaatccattaattctgctttacgacagacatcagtataccactgagcaaaatcgtcttccatcgccgttattgcatcatttttcttattatttgccattatttctcctcatttcattataatctttccctattttactattaataaagtgattattcaatagcaatctttgtttctttgttcttccgtgaaagaataattttatgatcaattcgctctttcaattcactaacatgcgaaatgattccaattaatttaccatcttgttgaatatcaatcaaacagtcaattgcttgatctaatgattgactatccaaagaaccaaagccctcatcaataaataaagtatttaattctatccctccagcataaccttgaatcattttagaaagccctaaagctaaagataatgccgctttaaaagactctccacccgacaatgttttaacatcacgtaaaagtccactttctaaatcaagaacatctaattccagtccttgctttcctgcccctttagagcggttatcacgacgataaagctgatagcgtccttgcgacatacgttttagcagggtattagcataaactagaatattttcaaaatatgccgctaaaacataacgttcaaatgaaattcgatagctgttttttccagatgtaacctcacttaaatctaaataacattgataaatatcatggctattacttaattcctgatcaatatttttaatattcttgattgtactggttactgtcattaattgggcatttaaattatttaaaatatttaaagcagaatctaatttttgttttaaaataattagtttttcttttacgacttcaacatctataacttcaattccctttaattcaagttgcaattcatgaatttgtttattcaaagaatccttggcaattaaataagcctgatactccttttctttattttcaagctgactgacgtttttaataatctctaaaaattccttttcatctgtaaataaactattcagtttcccacgatattctcttagtacttgctgataattattttcctcatctttgatttgctggcaatacgacctattttgagcttccaattgaataatctgttcatttatagaacggtatttttcttcaatatctttaattattttagtcaaacctaacaattctttttgcttttcttcaatttgctgatcaacctgatgatgcgttaaatcttttaattgtttattttgttccattcgtccaatgacttgatttaattgatctttataagcttgtacttgtgcattatttttttgaatattctgttctaataaatctagatccttctgatgattagctaaacttatttttaagttatttaaataaataatttcattatccaattctttagcctgttttaataatttattttcatcgatattgatctttcctaatactttaataaaaacttctttccccaattcttcttcaattcctaagcgctgacaatcattttccatttgtttctttaataaagtaacttcttgctgttttaatattaaagcattataaatatcatttcgtgtttcgctacacttatcaaaattcttttttgctttttttaaatcttcttgataaactattttttgatcaaaatctgccaattgtggatggtttaaagaaccacaaacaggacacggttcattttcctttaaactgcttgctaaaataccagcctggcttgatctaaaatgatgttccatttgatcatatttatttttttcattcaaatatttttcttcaattttttgatactgttcacgaagctcataacaatgttcctcttctcttaaaaatttatcataatcagagcttaagatatgaatctcaagtttatgagcatgaattttttgataattttgatttatcaactcataatcacccttaagtttatctaaatgagcaatactattactatctcgttcgataattttagcacttttttgtaatctatcatttaaaccgatatttttactctcaattactttaatctgtttccttaagttatttccctgatttaaatctttttgatatactaaaacattttgttttagttctaccattttttctaattcaatttgtccctgagcaacttcatcgtgatatttagagactaaagcatactgtttctcctgcttttttaaatcattttttgcaaatgataagcgttcatttaagactttttctttttctcttagcttagctaatttagttttactactaatcattagtgaatagatattttgaagttgattggctctttttaaatctttgatcatcttctctaattctcgataataatcctctttgcttaaataattcgatagctggatttttaaatcatctagatattctaagcgacgattatttatctcaatgacatttagctcttttgccttttgctcataatattgtgcattttgctggtactccatcgctttaatctttatctttttttctagtgaatccaaatattcatctaaatcaattttctcatcttctacatcaagactctttaacaacatctctctttgtttaaaaagtaaatcatatttactcttatattctttaactcgcaatttgagctgttcttctaagcatctaaaattatctgtcttaaataaattgcgtaatactttttctcgctcttcactccctgcataaataagttttgtaaattcaccttgggcaatcatagcaatttgtttaaattgcttatcatcgattcccaggatttctttaattttataattaacttctttgattccttctatcattttaccacccggcaatgttaataatgcagtgggtaacttaggtgtttttttaccctctaataaatatcgtggtgaccgcttaattaaataatgctgattatgtaaaataaaatcaagttcaacaaaagtaggagtatcatgattagcttggtcacttcgaaattgttcactactacgttcactcccacttgatactccatacaaagcaaacataatagcatcaaaaatcattgtttttccagctccagtaggaccagtaatcaaaaataaaccatcttgaataaatggctcaaaatcaattgtcactacttgatgatacggcccaaatgctgacatagtaagacgattaggcaacattttctttccctcccatcatgatttctgtaacaatctgtttggcttcagcacttagttctgtaccttttattttttgataaaattgttcaaataaagcaactgaatcaagtttttcaaatccaggatcagctttagtattattactcgtttcattacttattagttttggataagtaatctgcaatacatttgaaaattttgttcttaaataatcaatcgcattaggcactaacattgaatctgttaattcaactgcaataaaatcattattattaatggcaaacgaatctgccatgatttcatcaaaactcccagtgattttaattaagtcttgtttaggttgtaatgatacaagctgataggatacttttttattatcaatcgttacctcaactatacttttagtttgattaacttcgtcaaaagaataacgcattaaactgccactatagcgaatagtttcagttgatattttttgaggtgcatggatatgtcccaaagctacataatcaaattgtttaactaatgaaacatcaataatttccgttccacctacacttaatactgcttcactttcacttcgcataacttcactatttccagcaataaattgatgggtaattaaaacattcggtttagtaaaatctattttttgatgttcaagataacatcgaaaagcatcctgatatgtaacaatttgttcatcttcatacaaatagcgaatataagatggtttaaaaaaaggcattaaataaaaattaaccccttcaatttctatcggcttcatttgtttagccggatatgcttcaatatacaatccttcttgtcttagcaatccgctaacaaaacttaatcgactcgcactatcatggtttcccgctatcatcaaaacttttttgtgatactttaaaataacttttgttaaaaaatcatttaaaacatcaatagcttcattactaggaacactccgatcataaatatctccagccatgactaaaacgtctatttcgttatcgactaaataatcacaaacttgattcagtaaatcagcttgaatttctaataaattttgttgatataacaactttcctaaatgaatatcactaatatgaacaaatctcattattttcctccttataatttaattaaataaacctctttaattgtttcaccggcttcaaaatctttccgatattttttaggtatttctactgtttctaaatattgtgcttgtaattttaaaatcgtttttttagaagctaaattatttggtgaacaagtaattatcagttccttaaaccctagttttaaggctattggttttattaactggactccttgatacgcataataatgcccacgaaattcgggctcaacagtataaccaatatgtccatcatagtatcgttcttcacaactaccttctcgtaaagtcattcgccccacaatttcattgtttactttcattaaaaaaatataatatggtttccagccagctggtaaatctttatcaatatatatttgtttttctaactgcatctctatcaccttaacacattatatcataaataccattttgatgaggatgaatattattactttgactgacaatatttggttttataatcagcatatctaaacacaatttagtcaatttatggtagaatcaaagaaaggggttgaaaccaatgaaatttaaacggctcgatcgggtagattatcaagtatcgatcattacaatcataattgtttgtgcatcctttttttgtgtctatatttttaattataaaatcactcacgatgatatgatctatagtctaaaagaacgttcaaacacgatatatcattatgtagaaaattatttagacaaagatacttttaatcataatttttctcttgatatgaaaaatgatacttataaacaaataaaacaaaaattagaagatgtaaaaaatgcaacaaatgttttatatctctatactgcaaaaatgacagatgaaggcgaatatatctatcttgtcgatggactgccaactgcaagtccagattttcgttatcctggagataaaattgaaaaagaaataattcctgagcttaaagcagcattaaaaaataaaattattttgccagatcagattaaggaaactacctggggtcccatttttgtttcatattaccctatacacgacgaaggaaaagtagttggcgtgttaggaattgaatttgatgctagtcatcaatttgaagcctttaaacaaattcgaattattacaccgttgattgccattatggctagtcttatcgctactatcattgccgttctatcatttagaagaatttcaaatcctcgttttaaagatatggctaatactgattacttaacaaatttacataatcggaatgcttttgaaatagattttgaaaacttatcaacacataagcacaataccggaataattattaccgatcttaatgatctaaaaaaaatcaatgatacatatggacatcgtactggtgatgaatatattaaaaaagttgctaaaattcttgaaaaacatgtccaaaaaaatacagtttatcgttttggcggggatgaatttatcattcttattcatcatgatgccaaacagcaaatcaaagctgttgtaacagcaattcaaacagagctttcaaaacaaactgatgaaaaattatcaatctctattggttttgctgtttatgatcctaaaattgatcatgatttaaaggatacattcaaacgtgcagatgctaaaatgtatacaaataaaaaactaaataaagaaaaaaataagtttgaggattaatcctcaaacttatttttagttattaactcaataattttatcagtaatattttctaaagtatcatcattaacaatacgatgatcacaagcttcaagataaagctgatgccgttgtttatctaattcatatagtttctgtgggccctcttttaacaaaggacgacttgtaacttgaacatccgttaaaatattatcaataggtcgatcaatataaatgattattccattttgctttaaatatttaatattttcaggtcttaaaacaacccctccaccagttgaaataatatgcccatttaagtcggaaacatctttacatccagcagtttcattattcctaaaatatgtttcactaacttcaaacatctctggaattgtttgatgatatttttcaacaatatattcgtcaatgtcaataactggtctgtttaatttttcaccaagcattctagataaagtagttttaccacatcccataatgccaattaatacaatatttttcatcttttctccctatgcatgatggtaattgcctaagactcttaaggtaagacaatttgttttcatttgttctaatgccaatttgacattatcatcatgaagactaccttcaaaatcaatataaaaataatattgccaacgtttatcctttataggacgcgactcaattcttgataaatttatttggtgatctttaattgcttttaacaccccatataaagccccaactttatgctgtaatgtaaatacaatactcacccgatcagtttgaggatgatcttcaagatgtttagcaaaaataataaatctagtattattagttttttcattatgaatgttttcctgtaatacttctaaatcatacagttttgcagccacttttgaagcaatcgctcctttagataaatcattacattcacttacatactttgctgctgcagctgtattcgaaaagtcttgagacaacatttgaggattatttcttaaaaaatcagctgactgctgaattccttggggatgactatagactgttttgatattttcaattttagcccccttaatccctaataaatgttgtgaaatacagacactgtgctcaccaacaatatagaaatcgtaatcccgaactaaatcataattatcattaattgctccagttgaagaattttctagaggaacaatcccataatcaatttccgcattttttaaagcctcaaaaacatcacgaaaattaacatagttagtattttctacatttccaaagtattctaacatcgcctgatgagcaaaagcaccaggcacccctgcatatccaactttaatattttctcgttttggtgcagctaaattataaagattatttagaggaataaaagtagcttgatagctcttcccgacatccataacatcttgcataaaattacgtgcataatcagcaagctctggattcagcatccgtgcagcatttttttcaattactgctttttcacgttctggttgaaaaatttctaatccatgagctaatttgtaagtgacaacatctttactaacattcattcgctgctcaaataatttaatcaattgttggtcgatttcatcgatttcacgacgacattgttctaaatctttcataaattacctcaccaaatccaacattgctaatgctgccatagcttcgacaactacagttgctctaaaaacaatgcaaggatcatgacgtccatgaactcctaatgttgtattttcatgtttttttacatcaatcgttttttgttctttagaaatagaaggtgtcggtttgattccaactgtaaaaacgactggcattccattagaaattccaccagtaatcccaccattgttattactagtagtttttactagagcatcttgataatagtaacagtcattagcttcactaccaaataattcactaatcttatcatttccaaaagctactgatttaactgctggaattgaaaataacaaacttgataaatgactctcaattgaatcaaaaaacggttcaccaagaccaggttttaaaccaataatcgcacattcaaccttgccacctactgagtcttgatccattcgtgcagcatcaacaatattaacaaacttttcatatttttcttgattaatgacaggataatgttgtctgcgtaaatattcaagtgtcttagttgataaacgcatatcaaaattttcatcatactcgtttttaatacttagaatatgtgctccaatttgaatcccctgttttgccaaaatttgttttgctatagccccagcaaaaacaaccggagcagtgattcttcctgaaaaatggccaccgccacgtacatcattaaatcctctatatttaataaaagctggataatcactatgaccaggacgcattttttcttttaataatgaataatctttagaatgctgatcactattataaattattccacataatggtgcaccagtcgttacatcatcctgtaacccactcattatttctaccttgtcagcttcttttcgagcagttgacattttatcctgtccaggagcacgacgtttcatttctttggctacttcctctaaatcaatcttgattccgcttggtagatttcctaaaacaatcccaattgcttttccatgagattctccaaaaattgttatctcaatattatttttccacgtcgatgacatcaataattcctcctaatgactggtaatcttcccaaaaacttggataagatttttctacacattccatattatcaataacaacaggctgactgctgcgagtagcagcaattgctaacatcattgcaattcgatggtccgcaaaactagaacaattaccgccagtaaactcattaacaccgcgaatcgtcattccatcaggtaactctgtgacggttccacctaattcattaagctgtgaacgagttgctatgattcgatcacattctttaattctcaatcttttagcattaataacatcacttttaccttgagctaaagctaaagctactgaaaccacaggtataacatcagggcattgactagcgtcaacaattgttgctgctaagttttcacccgtaaccttgataccatcactaactacagaaactttagcccccatggcttcaagaaattctaaagttgctttatctccctgtaacgaatcaagattcaaatctgttaatacaacatcattcccaatcgctccagcaactagataaaaagccgcctgagaaaaatctgcctcaactcgatagtcatgagcctggtattcttgtttccccattacaataaaacttttataatcattattgacaattttaattccatattgatttaacatctgcaaagttagatcaatatatccttttgattccaacggtgaagtgatctcaataatcgaatcaccatctaatagaggtaatgcaaatagcagtccagtgataaactgtgaagaaatattcccaggaaccttataatgatcgggttttaacttaccaattacatatagatcaaggatatcctccttataaagataaccaatattttgacgctcaaatatttcataaaaagtatttagcggtcgtttccccaaattaccgcgtccaacaaaatgagctttattttcctcaacaattgcaattggaaccataaaccttagcgtcgatccagattcttcacaatcaatctcactattttgctttgtataagtagttgtgccatcaatgattaaatagtcatcatatttctctattttggttcccaatgattgcattgctttaattgttgcttgaatatctttagaatattcaatattatcgatacgactgattcctttagctaaactagcacatataatagctcggtgagctaatgattttgacggtggtacttggaccacaccacttaatttagtcggtgtaatttttactgctgtcattctataccctatcctttgcttgaattaatgaaagattactttgatagacatagctatcccctatttcctttaacaatactaacgataattttttattaatatttttcttgtcaagacttattgcctccagtaagtcggttgtttttaatccgctataaactggtaaattatatttaatacaaatttcttttattatatcactagtccccactggtgataaatcattttcttcggcaattttagttaattgtaccattcctattgcaactgcttcaccatgtgaatatttctcataatgataatattgttcaattgcatgtgcaagtgtatgcccaaagttcagtaataaacgatccccgaagtcaaactgatctctttcgactacatcacgcttaataccaatgcaacgataaattatttcatcgatatccatgtataactgttcaaagttatcataactatttagtttatcaaacaaacttttatctttaatacagccatatttgattacttctcccatcccgtcattaataaaacgctctggtaatgtttttaaagtatttggatcaatcaaaaccattctcggatgataaaaagcccccactaagttttttccttctggtagatcaactgctactttcccccctactgaagaatcaacttgtgctaataatgaagttgggatttggaccaatttaacacctcgtaaaaaggtcgctgcaacaaacccggctaaatccccaataacaccgccgcctaaagcgatgattaaatctgttcttgttaatttaaaatctaataaagctttatataacgatggtaaaatatcaaaacgtttagactgttcaccatgaggaaccgttacatgctcaacaatgtattctttatttagaacgtttgttaataaatcaccataataatgataaacttgatcatccgaaattatcatgattttattaccttgatatatctccttgatatatttatcagcttggtttaagattcctttttcaatatagattggatagctattttcttttaatgaaactgtcatttccatcgttatatttcctcctaattaattatactttctttccaacaacttcagctattttagaaatttgttttaataattcttcatatctttccggtcttaatgactgtggtccatcacacagtgccttctccggattgttgtgcacttcgatcattaacccatctgctcctgctgctactgctgcttttgccattggttccactaaccaccatttccctcctgcatggcttggatcaattatgattggtaaatgtgttaatttctttactaccggtatagcctgtaaatccaacgtgtttcttgtatatgtctcaaatgttcttacccctcgttcacataaaattacattcggattcccgtttgccatgatatattccgctgacatgatccattcttcaaatgtcgcacttaatcctctctttaataagattggtttctttgttcctgctcccactttctttaacaggtcgaagttttgcatatttcttgccccgatctgaattagatctactttctcattgaattcttctaaatactgggcatccatcagttccgaacagattggcaatccagttgcttctttagctgcaacaagaatatccagaccagaagaccccattccctggaatgcatacggtgaagttcttggtttgaaagcgcctcctcttaaaatattagcaccggcagctttggcagctttagcaatctcgattacttgttcttcactttcaacagaacatggaccagcaatcaaagcaaggttgtcacccccaactttaacaccagcaacatcaacgatcgtatcatcaggatgaaaagcccggttagcaagtttatatggctcagatacacgcattacatgatcaactgcttcatctacttcaattgctttaggatcaatttgagttgtatccccaataattccgataactgattgaccagttccatttacaacactaacatttaaccccttgtcagtaaccatttttgatactttttcgacatctttttctgtcgctgtcattttcattacaataatcatttttctatccccttttgttttatttcaactctgtatataaataaaaaactctcttcctataaaaggacgagagcttatgcttcgtgataccaccttaatttattaatgtattgctacactaacctcatcgagtacgctaatcaaatagttcatactcttacacgttaacgggtgttgccggagagacctactactaacgattcagtcctctactccaagatgaattcaatattctctaatagactcttttacaccagccaagagctctctaaactattttgaatacttactatttcttttcacagtatttatatcagatgttgttgaaaacattgtatacaatagaatgaataatgtcaatcttttttaataaaaagtttttttatttctattttatagtccatataagtctacataattctggcggtcacaatagtttaagtacgttataatcttgttaaaaggaggcgtattatggaaaatattgatatagcattaattggtaaatatataaaaagtactcgcctttcaaaaggctggtcgcaatccaaattagaaaaaataaccggtttatcagcatcctccattagtaatatcgaattaggaaatcgtggcgtttcttataatatttctttaccatcacttgttaaaatagctcacgcttttgaaatgagtttagttgatctattaagtcaatctggctatttaagcgcaatcggtgacgaatgttatgaagctgaaaaatctcaaatatatattcataattatgaattaatcaatatttatcatcgtctcacaccgattcagcagcaagaatttgttcaagaaataaagaaattagttagccagtctgatctagccaagcaacaaaagatgtttcgaaaaaaaccttaacgataattttatttatctgttaaggttttattattcctcattaaaacaaatcaatgtatttttgcctgataattttgcttgatacattgtttcgtcagctcggacataaatatcatcaaaggttttatccgttgaatatattttagtaactcccatactaacagatactggtacttttagttttagctctcgagcaatattatgaatctcttgatgcattgtttgtaatcttgctcgaatcgtatcttgctgcataagcccaagaaacatcaagaaaaattcatcacccccaagacgcgcagcaatatcatcactgcgacaatatttttgaaataattcacctattttaatcaaaacttgatcaccaatataatgaccatgtagatcatttatttctttaaagttatcaacatcaattactactcctgttacattttccaatccttcatctaacacttgattaacaattgtttcacatgcaaaacgatttagcaaacctgtcatatgatcataatgtgccttattttttaatttttcttcatactctttgcgtcttgattcccgctctttttccgactggatatttttcattgttccaacgattctaactaaatcgtgataagtattataaattcctttcgcacgaaaatgacaccagcatttacttttatcgattaaatcaacttctagatcattatcaagatgatgattattttggtaaaaatgttctaaaattaatcgtttgtttattctccaaatattataccagttttcttgatcatttttatcatcaacatcacttccataaaacatcaaactatcatatccaatttcataatcaaaaaagcattcttgaacaaactcagtaaaaatctgataccgttgaatttcttgttctaggcgctcattagcttctactaatggcgtaatatcagtataaaccatatacattatagggtctttatcctcatataattcatctaaaaaaattcctttagcttgcacccaagcttctttaccctttgaacattttaaacgatatttcaaactaaatggctctttagaattaacatacttgccgatttcttgatatacatattcacgatcatcgtcatgaataaactgactgctcgaaaaatatctttcaccactgccaataaaatcaactccaatcaatttagaaattccctcactacaatatattactgtaaactgtggatcataaacaatttttccaactgctccaattgaaatagaaatcaattgttcgaattcagtcatatttgtttttgccaaatccctaaataaaaataattcttctctggttctactattattcatcttatttcactactttcttcattacctatccatcaaatcatcctagtatttttcaacatcgtgacgttttggaattgcatttgcagcgccagctttcatgactgctaatgcagcggcattagtagcaaaagtcaatgcttcaattgcacttttaccttcaattacagcagctatataatatcctgtaaaagtatctccagctccagttgtatctaccgctttgaccgttcgtgcgggttgatacacgcgctgctccttatcttgaaaatatactccatcttgtcccagagttaaaacaactttagcctgtggataaagatttttcattcttgttaaaatacactcggggtcataacatccagtaatttgggcaccttcaacttcattcattaaaaaagtattgactaatgataaatcacatttatcaatatactcatcgtatggtgaaggatttaaaaaaatattcatccctttctttttaccttcaataattaaataatcgattaaattgacttcattttgcagtaataatatatcccctttactaaattcagtcagaactttgtcaatccaagctttatctaaacttcgattagctccaggatacaaaataatactattttgtccttgcgaagttacttgaataatagcattaccggtaggtatcacgccagtttcaataaaagtagaattcactccactatcattgcaaagttcaatcaaaaactgtccatcaatcccgattttaccagcatgatatacctctatccctgctcgagctatagcaattgactgattcaaaccttttccaccagcatatacgctcatttatttagatgtaattgtctctcctggggcaacaattcgttctaactgatatgtatggtcaatatttaacgatccaacatttaatactttcataattatttatccctctttcactgtcagcctaatagtatcatatttaaatcacatttccaaacaactttaaaaaataacctattaaaccaaaaaacgacaaaaatcactgtcatatgatgtaataataaagatgtagaagttatccaattcaattggccaattaattagatgactagtgttattgtataaaacatagtgcacttatatacatatttataaaaaaaagccaatacagcagtatcggctattatttcaatggtacccgaggtcggactcgaaccgacatggtataaaccaaacgattttgagtcgttcatgtctaccaatttcatcactcgggcaaaataaatttatgctatatataaatatgacattctggcaaaattgtcatttcacatataaccatgtgcctacaacggcaactaacagaattaattataaagaattcttttaataaaagcaatactaaatttaaatgaatttaacaaaaaaatatttttattaaattcaagtaaaaaaactgtctctatatcaacactttttacgtcatagaaaaaaattttaatcaaacttattcttcacttgttttagtaattttagaatatctattgacgaatgaataaaaataacgtatttttagtataaaatatagggatgaacaaaattatggacaaaggaagtaatattatggaatatgaaaacattattagcgaattaaatgaaattactacttcattagacgctacaacagaaacattagtcggtttacaagaaaacgctaaacacgaagaagcaataaagaaaattgatgttgatttatatcttgaagccccaattcaagaattaagccgtttagcaaatcgactggctgaattaagtcatattattaatgaaaaataattaaagacaagcgatgcttgtctttttatttataattcttgtataataaaaaagaggtgaactatgaacaaactatttgaacaacgaatgcaaaagcttttacagaatgactatcctgcatttgaatccgcattaaatcaaaaacctattaaaagtttttatttaaatcccctaaagcatggaagtattgaacatttaaattcagcatttttaaccaaacatccctacatcaatgatgcttatttttatgattatgaaaattatcagttaggaaaacatccttattttaactgtggtttatattacattcaagaaccaagtgctatggcagtagctaactgccttgactttgatcatgacgattatgtattagatatgtgtgccgcgcctggtggaaagacatgctttacagctagtaagttaagtagtgctggtttaatgattgctaatgacatcaataaacttagagctggtattttatctgaaaatgttgaacgttttggtcttcaaaatacaattgtaactaatagcgacccagttaaactagaaaagtattttaataatttttttgataagatcatccttgatgctccttgctcaggcgaaggaatgtttcgtaaacttgatcaagcagtagagacctggtcaattgaaaaagtaaatgagtgtgcttatattcaaagaaatttaattaacagcgcttatcaaatgcttaaagatgaaggtattctaatttactccacttgtacctattcgcttgaagaaaatgaatatcaagttaaatatatgaccaatgatttacaaatggagttattagaaataaaaaaacagccaggaatggcttctggttatcagaatgataaagttgtccgaatgtatcctcatcttaataaaggtgaggggcaatttattgctcttttgaaaaaacatactaatggttcaacaaaaaaaataaatttcttaaaaccgaatgttactaaagatcaattaaatcttgttactaaattttatcacaataacttaaaccttccagtcccccaatatttatataattctaataaccatatttatgcaattttaccgcaattcccagatctaaaggggacaaaagtcttacgtaatggtttatatttaggagaatgtaaaaaagggcgttttgaaccaagtcattctctggctctttctttaaaaaaagaagatgttaaacgctattataactttaaagctgatgatttaaatatttccaaatatcttcacggagaaactctaatcggtaataaccaaaaaggttatggtttgattcttgtcgatggttatccattagcattttacaaagaaagtaacaatcaagtaaaaaatctttttccaaaggggttaagacgatgagaagatatgagataatcaaggacgaagtttatcaaattttaaacactaattgctttggtaataagcgtaaacatggtttagaacacctatttagcgttgctgcaatgatgaaatatctagcaatccaaaataacctaaatatagaaattgctgcaacaatcggcattttacatgatcttgctacatataaattgaattctagctttgatcacgctaatcgtagtagtttaattgcctcagaactattaaaaaaagatgaactcttttcagcaaatgaaatagatactattgtaacagcaataaaaaatcattcaaataaagaaagaattgatgataaatatagcgaattaataaaaaatgctgaccttttaatccaataccttaatgatcctgaggcccttttaaccagtgaaaaacagaaaagaattaatcgtcttatagaaagcaaatagtaattgctttcttttttgtgcctacaatagataaaaggagaatcagttccatagaaaataaaagtattaatttaatccgccgacccatagcaattaaagtaattgttattcatagcaaattattcaaaccacttaattttaatctatatatccttattaacaacggtttatgccgcctagctgtgcctctttctttattactttaggttattttttctatcataaattagtaaattatcgatgtactactaaatattttccccttggttatccctattctttattatgccccattcaaattccttgcagcattgattagttatctatttgtaagtaatttccttataaataaaaatgcttagtttattcaatcaatctccgatcgttagttatcgaatctaactttaggcgatatctcatctttactaagctttttttaaattgtctttaatatatcaatattatcttggatatgtctagccatcgctttactagctccttctttatctttattagcaacagcttcaacaatcaaacgatgtgtaataattgtttcttggacaagggatttatcagttacatcgatagcttgttcaatcgctccagcaataattggaattaattttccaataacccgattaccgctaacccgagctaataaagtatgaaattcaatatcttgtacagtataatctttatttttgttaattaagctttcaatttcatcagctaagtctgataattccttaagttgttttgcactaatattatcaattgttttaataatcatttgcggttctatcaacaatcggacctccaaagcatccattaaaactttagttttatcagtttcaaaagtaaaccccagtggatcatcactgattcctggctgatcagccacaaaagttccaatcccacgtttaattattacgactccttttgaatttagacttttaatcgcttcacggatcgttccacgtccaactttaagtttattcattaagtcaacttcattaggtaattgatcacctggttgaagaccattttcgtttatatagccaataatttgctctactgccaactctggcagcgtttttttacttcctaattttttcattttctcgcctcgcctataaattcttacacattttattatttttgtcaattttaattaacgctattgacaaacatcatcaagccttttagaattaaattatatttaagacgtcatacgtcataggaggataaaatgaaatcacaagaattacgtaaaattgcacctgaaattgatccactaaggattggtactggatggagtgttgccgatctaagcaaacctcaaattatgattgaaagtacttacggtgactcccaccccggaagtgttggtcttttagatctagtctatgaggttgaaaaagggatcaatgatcatggtgctaaagcctcaaaatttttcactaccgatatttgtgatggtgaggcacaagggcatgacggtatcaattattctctagcatctagagatatgattgctggtatgattgaaattcacaataatgcaactccctttgatggcagtgtttttgttgcaagttgtgataaaggtatgcccgctcacttaatgggagccggaagaattaacaatccttgtatctttgtaactggaggtgtaatggaagctggtccagatatgctaaccttagaacaaatcggaaaatatagtgccatgtatttacgtggcgaaatctccaaagagcaatttgagtattatcagcatcatgcctgtccaagctgtggagcttgtagtttcatggggactgcttcaacaatgcagattatgaccgaagcattaggattgatgttacctggtacagcattaatgccagctacttgtaaagatttaaaagagcaggcctataaagcaggaaaacaaataattaaattagccaaaatggatttaacagctcgcgatattgtcaccatgaaatcatttgaaaatgcaattatggttcatgcagcaatttctggaagtactaattcactgttacacttaccagctattgcaagtgagtttggaattgatctaaatgctgatttatttgatcagatgcatcaaaatgcacattatcttcttgatattcgtcctgcaggaaaatacccggctgaatatttttactatgcgggtggtgttccagcggtcatggaagcaattaaagagaatcttaatttagatgtaatgacagttactggtaaaactttaggtgaaaatttggaagaattaaaaaataatggttactatgaaaattgccaaacatttttggataagatcaatctaaaaagcactgatattattagaccatatgatgatcccattggaaaagatggaacaattgccattttaaaagggaatttagcaccagatggagcagtaatcaaacattcagcatgtcctcaagaaatgatgcaagctgttcttagggcccgcccatttgatagcgaagaggcagccattgacgcgatcatcaaaaaacaaatcaaacccggtgatgcagtatttattcgttacgaaggacctaaaggtagtggaatgcctgaaatgttctatactggtgaagccattagttctgatcaggaactagccaagagtattgcactaattactgatggacgtttttctggagctagcaaaggaccagttattggtcatgtctcaccagaagctagtgagggaggaccaattgctttaatcgaggaaaatgacttgatcaaaattgatgttcctcaacgtcgattagaaattattggaattgaaggaaaacaacgtacctcacaagaaattacaaaaatattaaaggagcgccatgctaaatggaagccaaaagaaccaaaatataaaaatggaattttatcaatctacacaaaacttgctacttcaccaatgaatggcggaaaaatgaaaggataataacatgaataaaataatcaacgatatatcattatatggtatagttccagtaattaaaatagagtgtttagaagatgctccatatcttgccaaagctttatgcgaaggcggtctaccagttgctgaggtaactttccgaactgcatgtgccaaagaagcaattatagctatgaagaaagcttgtccacaaatgattattggtgctggtacagttttaaatccagcacaagtaaattcagcaattgaagctggtagtgaatttattgtttcacccggtcttaatcccaagaccgttcaatattgccttgataaagatattcctattttacctggttgtgccaacccaagtgatatggagcaggcgattgaattaggcctagatgtagtaaaattctttccagctcaagcaaatggtgggcttcccgcaatcaaggcaatgtcagcgccatattgcaacttaaaattcatgccaaccggcggaataaacactagtaatttaactgaatatttagcatttgataaaattattgcttgtggcgggacttggatggtcagcgatgaattaattaaagaacataaatgggatgaaattactgctattactaaacaagcagttaaaaccatgctagatattaaatttcatcatgttggaatcggagctggtgatcgaggtgctcaattagcggctctaatcaatagtcctcatcaaaaaaatctttctatttcaagaatggtagatgaaatagaatttatgtttgatacgcctagtggttccctccaccacctatgtttgtcaaccaagagtattgaacgggcaatattctttctagaaaaacaaggttatacttttgatatgcaaactgctcgttacaaccataaaaataaaatcgaatttatctattttaatgaactaataagcggttgtaaatgtcatttatgtctggagggataaaatgaaaaaaatattactatttggagagccaatggctctgcttacaacaacatcgtatgattcattagatgaagccgagatgtttaaaaagacactagctggagccgaggttaatgttgctatcggattaacaagactagggcatcaagctacgtatttaactgttttaggtgatgatccatggggtcattacattaaaaaaaagctttatcaagaaggaattgatacaagattagtttactataatagtctttttccaactggaatgatgatgaaaaatcaagttattgagggtgatcctgatatttactattatcgtcaaggttctgctttttcgaatattgacactaatctaattgatcaaatcaatttaaatgactttgaccaattacatattacaggtatccccctagcactgtcttctaaaactcgagaaactagtttaaggcttgtaaaaaaagctcgtgaagccggtctttatatttcatttgatccgaacttaagaccatctctttggcctaatcaaacaacaatgatcgataccactaatgaaatggccaaatattgtaatatgttcttaccaggcaataacgaaggaaaaattctcatgggcagtgatgatcctgaaaaaatcgctgtatattatcaccagctaggctgtgatgaactcgtaataaagcttggttcccaaggtgcttattacagcagtaaaaatgaaactttaacagttcctggatttaatgtaaaaaaagtgattgatacagttggtgctggagatggctttgcagcaggaattatttcaggtcatttggaagcattatgtagtaaagatatgttgattcgtgcgaatgcaattggcgcgattcaagttcaaacacttggagataacgaaggcttaccaaatattgaagaattaaatgcctatttaaaaaagtcaaattgtgaagcaaaccccgaaagctggatataaccaacttttgggtttttattatagcaaagccaacaacagagcaaaaaattggtatctatattaaacaaatacaaggaatattacttatttcattatcaaaagggtataagctaggaaagcacaatgtgcatgatttaaagaaatttcatgtttatgaaggattaaaagaatccattaattcctatataaatttctacaataacaaaagttacaagaacgattcaaaaatataacaccaccagaagtacgctttatagctttagatacagtcaaggaaccaactcagtatcctataaaagaagatatacatattcaagagtatttcgataatttaagaattttacacaataattatatactgatataaaaaagacgtttcaccaaatcagtaaaacatctcacactttttatttatttcatttgtctacttaacaagaatcaatccttattaataatataactaacttagcgtccaaaaaattgtattcacctcattaagcgacttttaaaaatgccaaaataattggcgcaagttttgcactattaataatataactactatgattttcattaggcaagatcattagttgacttccacttatattgtgagcgagatataacgtatgagattctttgatcatatcatcacttcctaccaaaattagcgtctttgcagttatcttagccaattgatattcattaatatgtggttgttccagcatcattttaatctttacatctttttttaaataatactgtattttcatcaaataataagcccaattttttaagccatcagggtcagcattagcaccactaatcattaaatattttatcagtttactttggctcgctactaataatccgacgattcccccatcactaaaaccataataggcaacctccgataattttaagcttttaataaactcaattatgtcctcagccattgattgataactatatacagctacactagaacttaaaccatgcccgcgactgtcaatacaataacaagtatagtgatttttcaatttggccactaatgcatcaaaaatatgatgatcctcaccgttaccatgaactaaaataagcggccgtccctgacccgatatttcataaaataactcaataccattaactaatattttcataacttatgctcattataaaattgctttaattctgctttcgtttcataatctaattgcgtttttttaattccctcaactgccccctctagtgcatataagcgatgaatacatgcagattcatcgatttgctgtatttttaaccatgcctcttttgctccaacttctttcagttttatcggatcatcaattcctacttgtatcagctgttgtgctactaccttaccaatatttggtaaatcctccaattttcccatattatcatctcctactcttattgtacttcaaataaaaaaacaaagcatctaaaaagatacatttctatttaattctttaaataaaaatgtatcgaatcatctattttattatttttttcgatagagtaaaaatgaatacactgaagggattattaaaatcgctccaacaaacaaaattactgcccaaaaagccagatcaaagaaactcataataataattaaaatacccccaaggaccattacatacccagctaaacgatttgttttattccaattatcctcgtcattcaaagtccatggtaatcggtagcccatagtaaaattttgacgacatttaggtaaataattccctaaaataacaaataatattcctaaaaatattggaacaactatattaattgagatttcatatccaaatacgattgcatatgttattgcttctaaaacaattgttatcgttggaattatccaaacaacaatttttaacatcttagatgaataattcttgtatttaggatccatttgcatcataaacaagcacaatagttgaattccactcatcaatatcggtaatagaaaaacaaaaatctctttactagcataattatctatttcacctgctatattccaatgaattggcatttgtgctggtaagcaatcataaataattagtccaaatagaatcggcagcaaacatactccgcatgtaattaatgccgttttaagtttcatctttaaatcctccaaattggctaagccataacattacttcttcaaaaacagaagtattaatttcataataaatataatttttgtatttattttcaaaaatcaaatctgcttgttttaattttgataaatgataagatactgttgcttgagtcatttcaaaacatcctgcaatttctcctgctgagagtttaccatctttaagtaacaccaatatttcacgacgaactggatctgaaagtgccttaaatgtttctgcaaaccccacaatcatcactccaatctatttagaatattttctaaatagattataacataaaacaaaggatatttctatcctttgtcattttctttaatacatttttcaatccgatcatgaactaatttagcaatatcgttagtatgaagatctttatattcttcataataaattggttttaaataatgaatttgagctgttgttttttttatcgtattattatcaaatactttataacaatcaatcaaagctaccggcacaattggtgcttttgctttagtcgcaattttaaaagttccccctttaaattctaaaatattattgccgtctctacttcttgtcccttctggaaaaacaaaaaagttttttcccgccgctacttcattagcaacatatttaataatttttgcactttctcggacattactgcgatccatcggaataaattccagcatcttaataacatcctttactaaaatgactgatgccaattctttttttacgattgctcgaattggacgactatgggtttgaaaaattgctagcgggtcaaacaatccttgatgattaggggcaacaaaataaccagatttcttgggtaaattttctaccccataacactctagctctacccttgctttgcgtgttacaattgctacaacttgatgtataaacccatagcgttcatcagcagaatatttatcaatatgtttatacttattgactttatatccccaccaatatggtaaccgccaaataacacgaataacaatcaatgcaattctcttcatttaattatcctcgcttatatgtttctaatgtaaatgtctcaaatggtttttgagcaaccaatttgtaaccgtattcatcaaaattaggaaaatatgtttcaccttcatgttttccaggaatccttgagattaacaactggtctgcaattggtaaacactgtttataaattgaagctccacccgaaataaataaatcttcaccactactacggtattcttctattacttcttctaatgagcttctcacttctactcgttcatcttcaaacggttcaaaactaacaacaatagttttacgattaggcaaaggacgtccgattgcctgatatgtagtcaatcccatcaaaattgttttatttaaagtcgttgccttaaaatgttgtaaatcttccggaacattccaaggcattccatttcgtgaatccttctttccaattaacagatcctcatctgttgcaacaattatatttatcattatacacttacctttccaactaatttaccatgactttggtaatcttctatcttaatatcttcaatcttataatcaaaaattgatttcacatctggatttaatactaatttacattttggtaatggttctcttgcaatttgttgtttaactacttcaaaatgatctttataaatatgagcatcaccaatcgtatggataaattcttttgcttcatatccacaagttctcgctaacatttccgtcattaaagcatacgaagcaatattaaacggtacccctaaaaaaatatccgcactacgttgatatagttgacaagacagatattttttatctgcactaacataaaactgtaaaaatgcatgacatggcggcagcgccatattatctacttgtgctggattccatgcacatataatatgtcttcttgaaaaaggattgttagtcagactatcaactaattttgctaactgatcaaccccttcataattaaaatcacgccattgagcgccatataccggccctaaatcaccatgtttttttgcaaattcatcatctgtcttaattttttctacaaactcttcaattgtttcaccattaaaatcaggtgatttcttaaaatcttcatatggccattcattccatattttgacattgcgatcaactaaatacttgatatttgtatcacccttaataaaccacaataattcttcagcaattggccgcaaaaacatttttttagttgtcatcaacgggaaaccatctctcaaatcataacgagtttgatatccaaaaacactacgtgttcctgttcctgttcgatcctcgcgattttctccgttttctaatacatatttacacatatctagatattgtttcattttttacacctcagcaactattgtacaataaaataccagtttgaacaacaaaaaaggtagatatcaatctacccaaaacaaatcattgatgttggcaacgctgtcgatagtcctccatcatcgctttaaaaatttcaccatttgaaggcggtgtatatgtaatggcatttgcacctgcttcaataactgcctgaattgtttcaagattaggtccaccggtagcaatgattggaaaatcttgagaaatctctcttaatgctttgacgattgcaacagtattcttaccacccgaaacattaacaattgtcgctccagaatgtaacatgcgttcctcaagattttcatctaaagaaacgattgataatactactggaatatcaacataatcagataattcttgaataaattcagtttttgtaggtgcatttaaaacaactgcagttgcaccatgtaattctgcatccaaagcaatctcccgtactcgaggtcctgctgttgttccaccgccaacgcccgcaaaaacaggacgttgtgctacatcgataattgaattagtaatttgcatggttggggtaaatggataaaccgcgattacagcatcagcattacaattggatattactgcaacatctgttgagaataataatgatttaattcttttgccattaataactattccactggcattgcggatacactctggtaccataattgtatggcttcttagctgtgtgttgatttttggtgcttctcttttcatttttttacctccccttgttttatttaataatattttaatacaataatatgaattcttaatgactagctatgaataaagtgataaactgctccaattaaatttgcttcatttccaaaacggcatttaactactttaggatgaatttttgcaacaggaatactatcatatattttttctaaacgactttcaatctgttcaattaaatcaggtcgtacactaattgctccaccaataataattttttcaggatcatagacatattgaagattatatatccccattgctaagacactatagtaccgatcaacatatttttgataaatagggttgtcttgtgcttgatcaaaaatcactttaccatctaaagtttgataatcaactcccaattctttagcaaccccttttactgttgcaactgtagatcctgcagtagaccaagaaatataggaatcattatcaagatcatttaaggccaccatatagccaaattcaccgccatgaagatgttttcctttatgaatcattcgatccttaacaacagcaccacctatcccagtgccactaacaatgaacatacagtcatccacatcacttccagatcctttccaaacttctgctaatgctgcacagttagcgtcgttttcaattgaaacttttgtgttgaagcgtttttgtagatcctctttgatattcggcccatggatataatctaaagcacttgctccttcaatattcccaacttcactgttaacggcacctggcatgcttaatgcaattcccgctacttcataattacaattatgataaatctcacccattgcctgatacattttttctagtgaatcgggcgttacgattttatcagtattaatgatttttccctgatcattgacaacaccatattttattgacgttccaccaacatccattgctaaataatatttcatctttttatccctcttttcaatattttaattatatcacatctatatctttcttcgaaatataaataatgtaaatttattctaataattttaattacgcatctataaaatagaagtttatcaaaccaaaaagaacacttagcaaatttaatttgctaagtgtttactattttttatcaacaatctgctgatttagcattgcgacaaaatcatcaaatggaacagtaatttgtttttgctctccatgtttacgatatgtaacagttttttcatcacgttcattattacctaatactaataaataaggtaccttatccatttgtccctcacgaattcgataacccaatttttcttcacgagcatccagttcaactttaaagcctttatcctttaataactcagttacttctttagcatagtctaaatgatactcattattaaccggcaatactttaacttgaacaggtgccaaccataatgggaacacaccagcaaaatgctcaattaaaattccaataaatctttcaatcgatccaaagataacacgatgcagcataactggacgaactttttcacctttatcatcaatataagtaatatcgaatctctctggtaaattcatatctaattgaattgttccgcattgccaaactctccctaatgaatctttaacatggaaatcgagttttggtccatagaaagcgccatctccaggatttactttataatccttacctgctgctttacaagcggcagctaaagcagcttcacttttttcccagattgctaaatcaccaatatatttcttctcgggacgggtagataattcaatttcataacttaaatttaagcttccataaacacgatcaatgaaattaatcaaccttataatttcaccttcaatttgatcaggtgtcatatagatatgtgcatcgtcttgagtaaaagtacgtactctaaataaaccattcaaggctccactagcttcatggcgatgaacttgacctagttcacccattcttaatggtaaatctttgtatgaatgtaaggaatttttatatactaacaaacttcctggacagttcataggcttaattgcaaattcacggtcatcaaccatactagtatacatatcttctttataattttcccaatgaccactagtttcccataattcacgtgacatcataattggtgttttaatgaattcatatccttctttagcatgttcttcgtaccagaattgttctaaagtatttcttaaaatcattcctttcggtaagaaaaatggcatcccaggagcgtattcactcatcataaataatcctagttctttacctagcttcttatgatcccgccgttttgcctcttccaataattcaagatgtttagctaagtcttcagaagtttcaaaacaaacaccataaattctttgtagtaccttattttctttgtcacccttccaatacgcacctgaatgtttagtcaatttaaagttcttacaagctttaactgtttcaacatgcggacctctacataaatcaacaaaatctccttgacgataacaactaatagttgtatcattttcaaaattattgatcaaatctattttatattcatcatctttgaacatttctaaggcttcttctttagaaatttcttggcgagtaatacgtttgccatctttacaaatctttttcatttctttttcgattttaggaatatcctcatctttgattacatcatttcctaaatcaacatcataatagaatccttcactaacaactggaccaacccaaaatttagcttgaggataaagatgtttaattgcttgtgccattacatgagcacaagagtgatttaatacacttagtttttcgtcttctttaaaatcaatcattatttttctcctttactgttttttaataaaaaaactctcatccaaaggacgagagtatcgtggtaccaccttaatttgttatcgaaataacctcaaagctataacgcactaccgacattctctttcgagtgttgcatattagggagtacctaaataaccttatcaagacttgcaccacccgtcttttctctgaatcaaagtattatctagacatatcctaaatcatcgcatctatttactatactaattctactcatttattgattaaagtcaactaatttgtttatttaactttttcgtcttgttttaaattataagccatccgaatattttcggtttctttttttaatgccttataaacaaactttgatggcatcttattaaacattgtcactgtgtcacacttgatacaatataaagcttgaatcccccgtacatttattcgtttgatccaatcaccctcggctttgcatattccacattcaattttattttgtggttcaactatttgtattctcattttcatcacccaaaatacagtatgcaccaaacaaattaaaataattgtcaaaataaatacggataagtgatctacttatccgtattaactaatttttttagatcttttacttcttgcggttttaaaatacgatatcttcctggtgttagcccttttaaattaattccaccaatacttacacgatgcaatcttttaaccggatgtcctacactctcaaacattttcttaacttgtcggtttttaccttctactaactttattttcagcattgtggttttatgttcggtatctttgtcaacgactttaatcttacatggtaaagttttaaccccttctaaataaacacccttttccagtttatttaaagttggtccagtaattaaacctttaatagatacttcataaattttttctaaatgtgaacgaggatgcataatcatattagcaaattctccatcattagacataataattaatcccgttgtatcaaaatctagtcttccaactggataaattctttctttaacttcagtaaaataatctgtaataataggtcggtcaaattcatcatctaaagtacaaacacaccctttaggtttataaaaaacataatatactttattttcaccaaccaacggctttccttcaactgtaattaaatctccctgttttactttggttcctaattcagtaacgactttgccatttacttcaacttttccttgaacgatcaagtcttccgcttttcttcgcgaagtataaccacttgccgcaattgctttttgtaatctttccatgtcttttcacctacttcgtaatcattatactgaattgtcaattaaaagcaaccaattatcttacgaataacttatttttatataaatatcctacagttcacttttataaacttgcactttggagtaaaatatagttataaataatatggaggaaacactatgagaggaatttattcatcattaactaaaattcgacgtaaagtttttgttgaagttgcaaagttagcctatgaggggaatgattatagtcgtatcgaaaatttaccctataaagtaattcctggagaagtcgcaacttatcgtgacagtatttttttggaacgggctattgtcggtgaaagaattcgtttaacgatgggattatcattgcgccctattgatgaaccagcaccaatatctaaagggattgaagaaagtattattgccgacaaatattacgaaccaccattaatcaacattattaaatttgcctgtaataaatgtccagaaaagaaatttgaggtcagtagtggctgccaggcctgtttagcgcacccatgtatcgaagtttgtcctaaaaatgcaatcagctttaaagacgggaaagcatatattgatcaagataaatgtattaaatgtggtctttgtaaaactaattgtccatatgatgcaattttaaaaagagaaagaccatgtgctaaggcttgtggaatggatgctattgaaactgatgaatatggtaatgcccacattaattatgataaatgcgtctcttgtggaatgtgcttagttagctgtccctttggggccattgctgataaaagtcaaattttccaattaattcaagcaattaaggccggcgatgaaattattgcagcagtagctcctgcatttattggacaatttggtcctaaagtcacaccagaagttttaaaaaaagcaatgcagcaattaggttttaaggatgtggttgaggttgccattggggctgatttatgtacaattgatgaagcaaaggactttttagaaaaagtacctgctcagcaaccgtttatggcaacatcatgttgtccttcttggtcaatgatggccaaaaaagaattcccggaatttaaatcttatatatcaatggctttaacaccaatggtattaaccgctcgtttgataaaagaaaaacatcctaatagccgagttgtttttgtagggccatgtgcagcaaaaaaactagaagcttctagaaaatcagtacgaagtgaggttgattttgttttaacatttgaagaaattggcgcaatgtttgaagctaaaggcattgattttgcttctttaaaaccagatgaagctgatccatttactcaggctagtagtgatggtcgcggttttgccgttagcggtggggttgctaaagcagtcgtaaattgtattaaagctaaagagcctgaacgtgaagtattagtggaatcagcagaaggattagcaaattgtaaaaaaatgcttaaattagcaaaaagtggtaaatatgacggttatctacttgaaggtatggcttgtcccggtggttgtgttgctggagctggaactttattaccaatcactagagctacaaccgcagtaaaaaaatataccaatagttctgataaacttaatgccaatgattctaaatataaagattatttggaacgactaattgaagaatataaataaagtctaaaatttaatgatataatcccttgtcgaacgacaagggattatttgtttttttagcctttaatcatattttttattgtaactgtttttattcaaaatcaataaaagtttgaaaagtaaaatgattttcattttcatcccaaatttcaacgaacttaggtgtagcctcaattaaaatctctgtttttcataactatacgcattgtaattttgtcataaatactgacgatataactgctcaaatttacgtcccagtttttcaatcactaagcctatatttttcgtcagcccttctatttgaattcttccattgcataatgcaacttgaggatttttaaataattgttgagtttttctaaaatttttatctgttttaaaataaacaactaatattacgaaccgttacataatcatctacactagtcgctaatacataattttccaatttcctaattttttaaaaaataaaacagctccatcttcaaaaatcacctctcttttcttttagtcacctgtatgatgaattatagtacttagttttttatataccaataatgtaatcaaatatacaataatacttttaattaaattaaagagaacaactcctacattaataataatttcaacccacgttcctttaaaagtaacaattttagttttatcataacgatagatcaaggctgctggttaaaccaaagcaatacttaaccataaaactttgtaattcacctgtaaacataagctgtatcaaaatataaaaatggtggtattaaaggtaatgggaatcaaaataccatcagcatcgcctataatgcccctaaaattgcgttcaacactaatcaccttgtctttcctcttttcaactttcttcctcctaaaataaaaaaccgaaaacataataaaatgccttcgatagaattctagaaaatgtcttttctcatctgaactttaaccgtcgatattagaattttactaactcagccatattataaaatatgggtcatgaactgtaaccatcggtagggattctcctcatgccacaaagactaatattaaattttaggttattgaaacaaattcaatgcttatagttatatatcttacctagatttaatacaattaatattataattacaaatattaggatattttgacagttttattttctactctaaaacttctatttttccaagttcaacatatgtttaaaggggtgaagaaaatgaaattaggattaattataagtttaatgatgacactagtaaatacaaacgtcagtgctgtacccttccaaggaaaaagttatattgtcatggaagctagtcatcaaatcgtaatcgaaggcagtaatcaagattacattcagagcgttgcttcaatttcaaaaattatgacctgtattattgcgattgaaaacatggaacttgatactatcattacagttgatgatacaataaataaagcctggggaagtggtgtctatatacatataggtgataaaatcagtctacgtgacttactatatggtttgatgcttagaagtggcaacgatgctgctgtaatgattgctaaagcagttggtaaagaaattccaaaatttgttgatatgatgaatgacaaagcaaaagaacttcagttgcatagcacaactttttctaatccaacaggtttagatgaagaagataacgggaatcaatccactgtttatgatatggcacgattaatggcctattgccatcaaaatccaatttttaatgaaattgtcagtactaaagaatacaaacgcgaagacggtaatgggacttggcataacaaaaataaattattaaccaactatgaatattgtattggtggaaaaactggttttaccaaaaaagcacgacgaaccctaattaccatagctcgtaaagatgatcttgatttaattattgttacttttaattgtggaaatgattttgaatttcatcaaaagaaatttgaagaatgttatgctaatttaaaagcaactaaaatattctcaaaaggtatcgttgaatttaaacagcaacagtactatttagactttgatgtctatgttaataaaaaaccaactgataaagttgaagtttcattaaataataatgaaattgtgattttattaaataaccagccaattgctaaacaaaaagttgttccatacaattactttttaggtttcaaaatggtcctgaaggatttattctatggctaaagtttttaaatttggtttaattttctttgtgataattgctttttgcactaataatcaaaataaaatgtttgaagcaattttaagttcaccacaacaagtttttgacttaatcaaagtaatcgttttaagtgcttgtctttggaatgggtttttaaatattattaaagcttcgggacttattaaacaattatcgtttttacttaagccgattttaaaacttatctatggtaatacggtcgaagatgatcaagtttatctatatctctcaactaattttattgctaatttattaggagttggttctttggcttctattagtggtttaaaagcaatgcaatctctgacaaaataccaacgtgatccaaagactccatgcaaagaaatgatgcttttagttattttaaacactactggcctttcaatcattcctacaacaatgatgacgttaagacaaagttatggcagccacgacatccttggcttctttggctatagtcttactattggtttcgtcattacaatcgtcggtattattgcaagtaaggtgattgaacattatggatagtgtaatcttaattatcattttaatagctctagtcgaagcaagttttaaacacgttgatatttttaatgaatttatcgaaggggtaaaggaaggcagtaaactcctaattactttatttccaacaatgatggcttttacactatgggtcacatgttttcagtattgcggcctaattgaactactagaaatcggttttaagagtatttttgctattttgaatattcctattgatatctttatgatgatgattgttagaccattttcttcaaatggatcactaactattttaaataatatctttttaaagtatggggttgatcatccttatagcattcttggctccattattcagacaggcagcgatactacattttatgttgtaaccttgtattttggcagtataaaacttcaaaataatcgatacgccttaaaattaggtctttggcttgatgcgattgcttgccttcttgcaactattgcatatttactctttatcggttagaacaatcaaatattatcaaaattcaacaaataacttgcataaaaggtgttacttaaagcaacaccttttatcaaacaattatttaatgaaaaacgtataatatccttggataaatataaaaataatcacacaaggaagaataaattttaaataattttttgtccattttgggaatttaattcctgttcctgtattagcttcttggagaaaaccatcaaatccccagccataacgacatgtgcaaaataacaaatacgctaatgaaccaagtggcaggaaattatatgtaaccaagaaatcttcaagatcttgaattgttgttccgataccaaatggagtaatatcactaagaatattaaagccaagggcacaaggtaaagataaaattaaaataataataaaattaactacaactgcttttttacgactccaattaaataaatccatcccaaatgaaataatattttcaaatactgcaattatagttgataaagctgcgaaactcataaagacaaaaaataagcatccccatacttgtcctaaccacatttcattaaaaatgctaggcaacgtaataaataccagacccggtccactttcaggatttactccaaaagcaaaacatgcgggaaaaataattaagcctgataataatgccactaacgtatctaaagtacatacacttattgtctcaccaaataaacgccgttctttgccaatatagcttccaaaaatagcaattgccccaattcctaaacttaaagtgaaaaatgcttgtcccattgcagcaaaaataatctctaaaagaccatattgtttaattgccgctaaattaggaattaagtaaaacgccaaaccgtctctaccaccaggtaaagtaacagcacgtatcaccaaaatcaaaataataattaataatgaactcatcatgatcttagtaatcttttctacaccattttgaaggcccaaggaacaaattccaaatcccaaaacaaccactacaatcatccagaatacttgcataaatggatcttggagcgaattattaaatatatctccaacttgtgctggagtaataccgttaaagtcaccttttatcattttaaaaaaataagcaatcatccagcctccgacggttgtataaaacatcatcaacatataatttccagccatttgaaattttccaattgcaccccaaaattttctcttaggtaccagtgaatgaaatgctaatgccgcacttttttggcttgcacgtccgactgcaaattccattgtcataattggtgctcctaaagcaattaaaaaaaataaataaattaatacaaatagtgccccaccatattgaccaacaacatatggaaaacgccatacatttccaagtccaatcgcgcaccctgctgatatcaagataaaacctaatcttgatgaaaatttttctctttctttcatgaaattaaacccttctattaatatttcttaataattctagcttagttaaacatgaaatgcaataaattgtttttaaatcaaaacaaactctcatcgaaagatgagagtttgaattaggcatagtttgctttattaacacttacatatttccaatatgagcgatattttcctttgcaggcaattacaggataattagaataaccaaattctcttgcaattgttcctttaggaaccttatttacatgtgttaattttccatctactacagcatatttcatttttagttcctcctttatttacacttatattataaacaaagaaaagactttatgcatttttattatgcagtttaaatcctataaaaaggttttaaaatcaataaatcaaaaaaatggaaatagcaaagctatctccaatatatgataaaagaagcgaatctttcaccacgactagaactaaattataacatattacaaacgtttcgtaaattatttgttttaaatccttcaatatttaaacaaacttcttcaatcacacgattacgagtttcaattggtgcccaggcaatatgtggtgtcattattaattttgttgcatctttgatttctaataagggactgttgcaacagaatggttcattttcaaaaacatctaagccagctcctgctaagcgatgttcttttaatgcctcaactaaatctgcttcatttacaatttttcctcttccaacattaattaaatatgctgaatccttcatttttgcgaaagctgattggtcaaaaagattttctgtttgactatttaaaggtgcatgaatactaataatgtcacttgattccagtaatgtatcaaaatcaacctgttgataattttgctggttattttttccacttgtagaataatattgaacctgacagccaaatgcggttgcaatttcagcaactttacggccaatatcgcccattccaacgattccccaagttttaccagtcaattcgtggaaagtgtatcctaaatgggtaaacatagagcttgatgcataattaccgctctcaacataattatggtaataatgatttttattgtataaatctaataataaagcgaatgtatgttgtgctactgcatttgttgaatagcctttaacattgcatacggttataccggcagccttacaatattcaagatcaatattattaacacctgtcgcagtaacacaaataagttttaatttatgagcatcttttaactgttcctctttcaatatatgcttattagtaattacaacactcgcatctttaatccgctcaggaacctcactaacttgactttgatgatatattgttacatcaccatatcgatttaatttgctgacatcaatatcactacccagtgtctcactatccaaaaagacaatcttaaaatcacttttcatcattgtaactacttcatcaaaaccttttccttgtatcatttttcctaaaataatagcttcatttaaatcaagaatttttgatggtcgacaatttccgctcattacaccatcattgatttgaaaatcaagatctttatttaataaagaaattcctaaactgcgactcgttacctcttctaattcttcaacactatttagaatttgattaacaaattcagaatttttttgaatacaagccctaatacaactactaaaatctttgcttatctttacctcttctctaaaaatatcatcaaataataatggtaaaacaagattataaagatccatcggtacagctccataacctttagtaaagcaatacaataaagcactccctaatttttcatctttcattccatctactaacttcatttttctctcctaaaaaatatttataactattctttgacggtcttgcatcgtcatatcatcataaatgataaaacagtatttaaatcgtttataacgatggtcatattttaatacattataacttaaatatcgactctttgattcttttgctccactgccacatgaagaaccagcagcaatcacatacatcccttcttgactgctaaaaaatggtaaatgtttatgaccatgcaaaacatactgaatttggtgttttcttaaccattctactaaatcacggctgtctactaatgccttagaactatccataattttcccaacaaaaatcttttcacgccatttttgctttaaaaaatcatcacgggtaattggaaacagatgatgatgcagcattgcaacaattgtataatctcctaaatttttaatagcggcaagctcttcatcaatattgtttaattgtttcattccaactttaccacgcgctaaattaccttctacagttgaatcaatcttaattaaaacaatcttttcttcttcaaatactttaatgctttcatttaacaaaaaggcgattactttacttttctgacgcttaaaaatattaaaaccattaacaattacatcatgatttcctaaaataaaggaaacatctgcattataacgattttttaaccctttcataaaccctgatgcctcatacatattttttcgatttggtgaattcattaaatcccccgtaatcaaaaactttaaaggataataagaacgtagctgtttaacagtttgatcaagactatcttcaagtgccaaacgaccgatattcttctttttgctaccaaggtgtaaatcacttagctgcacaaaaaagctatcataaggacttaaatatcgaattgaaaaaattgtatcatgttcaattttaaaaatgacttcttcaatgtcctgagtagtataaataggaacaaatgcacactcatcacctttaaaaattaaaaatccaggccagcgatcaatttgatataaggccgtaacaaaatgtttaaaaggtccataaaatgataaatcttctttttttaatagattatgacaatttaaaaccctaatattatcactgtctaaatcatccacaatctgatttgaggttaaatacgcattaattggctcactataatcaaaacttgataatactacgatctgatatttattacgttctgtattaatatactcttttaattcttctaaatgagtcggatccattttttccatgatttgttcagcatttttagctttactaaaagctaaaaacatatcataaccaatattttcaatggcttttaaattaataccacgtttacgcatccattttctcaactggcataaaccacgatattcgtcaagaatgcgactaaaataagttatgctatcatcaaaaattaaatttagataagcatttattaaatcatactcattcattatttgatcgcctccttatctattattataacccattcaaagcaaaagcctatataaaatataggcctttttgttaaaattttaaatttcttggtgttcttgggaaaggttcaacatcacgaatattttgcattccagttaaatacattaagaaacgatcaaatcctaaaccgaatcccgcatgtttacagccaccatagcgacgtaagtccatataccattgtaaaccatctttagacattcctttttcatccatgattctttcaagaacatcatatctttcttcacgttgacttcctccaactaattctccaattcctggaaccaataaatcacaagcagccactgttttattatcatcatttaaacgcatatagaaagccttgatttcttttggatagtctgtcaagaaaactggtcctttaacaacctgttcacaaatatagcgctcatgttcactatttaaatccattccccaagaaactttatttttaaatttaacatctgctttttctaaaatttcaattgcttcagtgtatgtcatccgtttgaaatcactgtttttaactttagtaattcgattgatgcaatctttatcaatcattgaagcaaagaattccatttccgcaggagcattatctaaaacgtaatcgatacaatatttaaccatatcttcaattaaatccatatcatcctctaaatcagcaaaagcaatttcaggttcaatcatccaaaattcactagcatggcgagaagtattagagttttctgctctaaatgcaggaccaaatgtataaacatctctaaaagccattgcaaaagcttcaacatgtaattgaccagtaactgttaagaaagcctctttttcaaagaaatcatcttcaaaattagttccatcaatagttgttgctctaaacatttctccggccccttcaccatcgtttccagtgataattggtgtatgaacataaacaaacccttgtgattggaaaaattcatgaatagccattgataaaacactgcgcaatctaaaaattgcatagaaagtgttcgcacgaggtcttaaatgcggtatttcacgcatgtattcgaatgaatgacgtttcttttgtaatggaaaatcttcatcacatttaccttcgatttcaatctcagttgcttcaacttcaaatggttgttttccttcaggtgtcaactttaattttccaactactcgaattgaactaccagtagataatttatcgatttcttcatagttagaaatttctgcttctgtatatacaacttgtaaatttttgaagtatgtaccatcatttagagcaataaatcccaatttcccattgttacgattagttcgaacccatccctcaagttcaacatattcgtaaccttctaaatccatcatttggttacttaaaaacatttcatatagttctctaaccgttataaattcaaacatattaatcctcctagtttttcctattatatactttattttatccattattcaagtattattgacgatttgaatccatcttaataactaattcttgaattgctacaacaacatctacctgttgtacctcgactccttcacgaactgtaaaatgtgtatgtgtaaaatcaacgatacctttaattcctaaatccattaaacgatcaactgttggttgaacgttttcagaaatagccaagattgcaattttacagtctttaggaaaagttttttctaaatcatcaatattatagagtttaacaccaaaacgctctccctctttatttttatcttgatcatagccgcagacaatttttcccaccgtatattgccaacggttatattttaaaattgcactaccaagatttccgataccaatcaaaataattgattcgtctagtcctaatcctaatacctcacttaatccgtcaattaaatgttttacatcataacctttaccacgttggccaaaattatctgtctttgataaataagtaaaatctctacgaatcgtcgtatcttgaatacctgttaaactagataattcgcttgataaacaattttctttaccttcatgctgcatttttcttaaagctttaagataaacaggataacgagacattgtagcgtttgatatttttttatccattttgatttcccccgctaaccgattcattttctaaatctaaatttggcttaattcctaatgacaaatcactaaataatttcaaatcgtacatctgttttgctgctaaagcaatcatcattgcgttatcagtacaacaactcattggcggtaataataattctactccatctaattggccaaccgcttcacccatcgcatttcgcaatccacgattagcactcacgcctcctgccattaatacttgtttaataccatattctttagtagcacgtattgttttattgactaaaaccgataaaaccacatcttgaaaagaggcagctaaatcttcttgattgatttcttcatttcgctgcatcgctttatgatttaaattaattacagcagattttaatccactaaaactaaaattatagctttcatcatccaaaggcactggtaaattataagtatgattacctttagcagccattttatcgattataggtcccccaggatatggtaaatttaaaactcgtcccactttatcatatgcttctccaacagcatcatcaagggtttgcccaattacttcaaatttaaaaggagcttttaataagacaagttcactatgaccaccactaacaactaaacaaagacttggatagataatattttgaacatagttattggcataaatatgtccagcaatatgatgtactccaatcaatggcttatgataagccattgcaatcgttttagcggcctgtaaaccgatatgcaaagacccaactaaccccggtcctttagttaccgcaatagcatcaatttcatcaatcgtaacgttagccttattcaaagtttcttttaatactagcgaaacacattcaacatgtttcctacttgcaatttctggcactactccaccatacatcgcatgaacatcaatctgtgaggccacgacactactaagaaattctcgttcatcttttaagattgccatagccatctcatcacaacttgattcaattgctaaaataagtgacaccgttattcctccatttcttttaccatcaaatacgcatcttcatgattatcctgatagtaattttttcttgttgcggcaattttaaagccacatttttgatataaactaattgctttagtattagaaactcggacttctaaattaatattcgaatagcctaaatgctttgtaatttcatcacatttagtcattaatattttagcatagccttttccttggaactcttttctaacaccgatagttgttatttgagtttggtctcctagtgtccacattcctatataaccaacaattatattattatcttccaaaatcaaaattgatgaaaaagcatttttttctaattcatatttaaaagcttcttcattccatggcgaactaaataaatcatgctctaactttacaacttcttcaatatcacctaaatccatccgtctgattaacatatttttttcgcctcaacatcttttaaataatgaggaacaagattatcaatattttgacaataatcaacacttttaccagcttgataaatacaatcacttaaatcgagtttaactttgttaattccgactaaatcactatcaccaatcacttgaaaatcaggatattgttctttaaaattagcaaaatcatcaatcaacatgatttgatcatcaattatggcctgattatgctcatataccccaacaaaaatctttttgcttcgagcatcaattacactgattgccttagaagctccagcataaccatgtaacgaagaaactgccttgatttttatttttgaaattgctgccaaagttttggcaatcgtcaaagcgacccgttgaccagtataagaaccaggaccaatcgtaattatcatttcatccacatttaaaacttcccaatgatgttttttcaacatttcatcaagatgtgttaaagcgtactcagattgacgccgatttccatctgcttgatacttatcaatacattgatcatcttcgtataggccaataactaaataagcatttgatgtatccattacaattgtcttcatgttaaagcctccacaacttgagcgtatttttcactatttgttttaaagacaaattcgcgaatattttcatcaattttttttatttcaattgttaaacggtctaccggtaaaatatcttcaataaaattagcccattcaacaacacaaacatcatcactatcaaaaatttcttcaaatcctaaatcatcatcctgtccttctaaacgataagcatcaaaatgtgataaattcaagcgaccttgatattgttttaaaatggtaaaagtaggactattaataaccttggtaatccctaatccttgaccaattcctttggtaaaggttgtcttcccggctcctaagtcgccacttaaagtcaatagcatatttggttgtaataacaagcctaaacgattacccaaagcaatcgtttcttcaaggttatttactttaattactttttccattgtattctcctatccttgtgtcaaatcttcatatacatgataccaatgtttcgtaaaatcttcactaaacggtccttcacgtttcgttgctaaatcaattagcagttctaattgtttttttaatattctatccaattcttttgaataattcatctgtttagcatgttgcttatactcttcttcatctaaaacccgatagttattatctgggaatacttttaaatctaaatcataatcaatatatttcaatgcctcaccatcatataaagttggtgaagcaatattacaataataataaactcctgttttacgaatcatacaaatcacattgtaccacttatttttaggaaaataacagatggcaggctctcttgtatgccacattcgaccatcagattcagttactaaggtgcgattattgattgcaataaaatgatcatcattttcatctaagatgaatcctttggcccagcatcgatgaatacttccatcgtgcttataacagtgaattaatactttttttcctaccagagaatctgacatcttttactacctctctttataacagtactattatacacaaattactatcctttttaaagacagaagaaaagaaaagtagcaagctacttttcttttacagtttaatcgaagtatttaatcgtggatatattaaggcaaatccgatgtagcaaataattaaagttggtaggcaataggctaaattataaccaaatgaataccaccatggattcattccctcaggagcatatgctccaaacagccatgctccagataaataatgtgagataaacttaagaatcattacaacaataattccaggataaactacatgacctttaatctcaaagtttttaaaaaatgatgctataccaattacagctagtggaattaaataatctaaaaataatgaccatggcccccaatatgtagccaaccctaaaacaaaatgcagtccacagcagcaggctccaacaacaataccgtaatatccacctaataaatatgaggctaataggatcggtactaatgacagcgtaatacttcctccctgaggctgtcccggaacgactttaaaagctaattctaaaactacttgtaaagccataaacatcgccatataagcaattgttttggttgtaatcttaaatgttttgtttttcatatttgtttttccccttccttatgaaagagcctaacaaaattaaaaaatgcttctttgcgaacgcaaaaaagcaaacaattttaaatttgctctctctacgctggcattacccagttcagatgataagggatcaggcttatgcccttctcagcaattttgcacccctggctcgtatactattatagattatcttattataatatcaagaaaaaaatcattttattgatatttctgtagcttcttttttaatatagtaatccaataagatgttttttccttctgctgccgaattaaaagaatctaaattaccagtaatataccttactgcttcttgccattcagacaaagcgtatgtttcagctcttaattcatttaaaaactgtaactgttcatggtcaagcgataatcttcctcttaaatcagaaatataggtacactgcataatatcggctattttttcaagtagacccatcgcttttctccttttctaaaataaaatatatgcgtttctctccctaaacgcatataccgaaattcatatgcttttattgcatatagagaacgataaatcagacaatatcgttcaaatgtattaaaataatatatatgtttttatagtgtgaaatttgttattttataatattttattacgaattttgaccgcataatagatgcttgataatctctaccttttaaggacaaataaatgtactaatgttattttccatgagcccatcttaaaaaagtatcctgtgaaacgcctaattctttagcagcctgccgtgaagcaattaaattttgttgccattgatgcttcaaaatttcaaaattttcgggaatttctttgcgagggcgtccaaatctcacaccacgcattcgtgctgcttcaatcccttctctttgacgctgacgaatattttcacgctctgtttgagcaacgtaagaaagaatctgtagaaccaagtctgccacgaatgttcccgttaaattatcaccagtactccgtgtatctaataatggcatatccaaaacaacaatatttacatttttttctttagtgattttacgccattggttttgtatttcttcataatcacgtcccaaccgatcgattgatttaataacgattgtatctccagcacgaattttccttaataatttttgatattgtggccgattaaaatctttcccgcttaatttatcaagataaatttgtttccttgacattggataattctccaaggcaatcatttgccgatcctcattttgttctcttgttgaaactcttgcataaccatacactttgttttccataatcttctcctttataataaattatttcttctacaagtgcagtattgcctaaactcgttcaatatttcgacaatacaacatttataaaaaatatttttatattttatctaactttaaagttaaaaatctacctattaataataatttgtattctttttatccaatgattaaaaaaatctatattaaaattaataaacgtaatgcttttatctagaaattttacaaaatgatgatataatgacgatagattaaggaggctttataaaatggcaaaaattatttctgtaaatgcaggtagttcttcattaaagtttcaattatttgaaatggatgacgaatctgtaattacatctggagtaatcgaaagaattggattagaagattcaatctttacgattaaatatcaaggaaaaaagactgttacaactaacccaattaaagatcataaagttgcagtacaacttttattagatactttaattgaaaaaggaattgtaaaagagttaaatgaaatcaaaggtgttgggcatcgtgtcgttcaagggggatcatactttgattcttcagcaatcattgatgaagatgttgttagtaaaattgacgaattaaaatcattagcaccattacataatcccgctcatttaactggatattatgcatttaaggaagcaatccctgaagctggagctgtagctgtatttgatactgcttttcaccaaactttagatcctaaatgctatatttatccaattccatataaatattatacagactataaagtacgtaaatatggtgctcacggaactagtcatttctatgtttctcaacgagcaatcgaaatgcttggaaatcctgaacattccaaagttattgtggctcatttaggagctggtggatctttaacagctgttaaagacggtaaatcagtaaatacttcaatgggattcactccacttgcaggaattatgatgggaactcgtagtggtgacgtcgatccttctgtaatcgattatttgattgaagaagttggaatggacatgaaagaagttattacgatgttaaataaagaatctggactacttggtatttctggtgtgtcaagtgattttagagatgttcaaaatgctgctttagaaggtaatgaaagagctcaacttgcaatcgatattttctatcgtcgtgttattgcttatattggtcgttattttattgcattaggtggtgttgatgcaatttgctttactgcaggaattggtgaaaattcattctttgcaagaaaaggaatttgtgatttattaaaagatgctttaggtatcgaacttgatgaagatgcaaatgttaatggtcaaggagatcgtttaattagtactcctaattcaaaagtaaaagtattcgttatcccaactaatgaagaattagtaattgctcgcgatacaaaacgtctactaaacttataaaataaacatgtagcattcctgctacatgttttaacgtgatgaaaattaaaaattttttaaaagcaacgattcatgaatcacttttaacaggaatcttgcttgctatcgttgggggctttttagatatttatacctatcttctaaaaggcaatgtttttgctaatgcccaaactggaaacatggttcttatgggacttaaaatcgctgagcaaaactatttaggtgctttatattatttattaccaatatcagctttctttttaggtattgttattagtgaatacattaagcatcgtttaagtaatgtccaatatgttgaatggcaacatttaatcttaattattgaaattattattctgacgatcattgcattcatccctaaagagattccctatagtgtttgcaacgtaacaattggtctagtttgttctttacaagtaaatacatttagaacaactaatggtttaccgtatgcctcgacaatgtgtactgggaatttgagatctgccggtcaaaaactatcagcatatttattcgctcatgataaagatgcgttacatcattgttttcgctatttgatcattatcttcttttttatcattggagccattattgctacaggtttaattaatatttttggacaatgtgcgctgttattttgttgtatattacttttgataactctactcattttagtttattagcctacttgttaggctatttttattttaacaaatgctcttttacatactttataatatcatcatgactgctcaaaacatcacaaaatgtctttcttaaatcaagccgctgcatatcaacgcaacgtatctcactcaactgtaaacgacttttagtctttacgcccgacatcatcacttcaatatccatttcaaattctggattagcacttgttccttttatagaagtacatggaataatcagcattttatagccaagatcctttaaaatataacaccagtgcccatccattaattctttagggaaaccacgtccgatattgaaatatgctaattgatgaacttgtggtcgattagaaagatgataatatgtactgtcaatatcacatccattttctttaactagatgacaataaaaatattctagttgatttgtcaaatgtttcaatgaacagctgtatttttcaacgtcataaatacctgtttcttctaaattctctaatgatttacttatttcaattaaattttcatgtacactcataatttatccctcctattatcatttactcctaaacttggaaaatcacttttattttttacaattttttttaatttattcataaaataattaaaaattatcaggaaatgagtcaatgtaaataataaaactaattatttatgctttatttctttgcatctattatcaaatacttcatattataatatgggttgcttttttaattttatttgtatataatagcaactgttattaaggagacagaaatacaaaatagcgccaggactaagtaattagttgacgagggctagacttatcgaaatattcggcggatggtctagaggtatgatactacctaaacaatgaacaaaaataatgagtaatcattaaacaaattcattcggtatcctccattgataacataataacaattgaataatcaaaactatggaggaatttttatgtgtggaattactgcgttttccggtaaagaagaagctttaccattcttacttcaaggactttctaaattagagtatcgtggctatgattcagctggtgtaacccttgtagataaagataaacttttcacgattaaaacgaaaggaagattgcaaaatctcatagatcgactagatcaagatactccaattggctgtgtcggaattggtcacactcgctgggcaactcatggagtcccatctaaccttaattctcatccccataccaataataaaaacactatttcactagtgcataatggaatcattgaaaattatcgagaattaaaggaacaactagtagctaaggggtataaattccatagcgaaacagatagtgaagttgtcgtccatctactagattcttactatgatggtgatatgctgaaagcattaaaaaaggtcattactcacattgatggaagttacgctttatgcattgtttctactttagagccggatgtagtttatgtaactaaaaaagacagtccattagtattagggacaagtgactgtgcaagttttggggcaagtgatattcctgctttattagactacaccaaagatgtctattttattgatgattttgaaattgctaaattatgtaaaaataaaataactttctatgacgctgaaggcaacgaaattcaaaaggaaattacacatatcccttatgataatgaagcagctcaaaaaggcggttacgatactttcatgttaaaagaaattcacgaacagccatatgctattagtgaaactttaagaggccgagttgaaggtaatgatcgaattattttgcctgaactagaaatattgaaagaacgttttacaacttttaataaagtatattttgtcgcttgcggaactgcatatcatgcttgcctttcaggagccaatattatggaacgcttaactggtattcctacttttacccaagccgcttcagaatttagatatggtgaccctatcattgatgaaaaaactctgtgtatttttgtctcacaatcgggtgaaactgcagataccatggctgctttacgtttagcaaaaaataaaggttgtactacgattgccgtagctaatgttcttggctcaactatctcgcgtgaagctgaagcaacaatttatacttgtgcaggaccagaaattgctgtagcaagtactaaagcctatactacgcaagttattgtcttattattattagcaatgtatgttgcacagaccctaggaaaagaaaatgatatctataaagacattattaacggaattgctaaattgcctaaacaaatcgaaaatattttaaaagatgaaccactatttgaaaaatatgcgaactatttaaaaaatcaaaaagatgcctactatattgggcgaagtttagattatgcttccgtcctagagggtgctttaaaactaaaagaagtatcatatatccatgctgatgcttatattgctggtgaattaaagcatggtccaattgctttgattgaagaaggcagtgtagtaattgcagttgctacacaaccacatatagcttcaaaaacaattagcaatattcaagaaacaattgctcgaggagcaaaagtcattttatttacattaaccggtgaagatgttggaaatgttgatgaaacttattacatgcccgatgtaaatccaattttacaagcagtattagttgcaatcccactgcagttaatcagttattatgccgctaaacttaaaggttgtgatgttgataaacctcgtaatttagctaaatcagtaacagttgaataaatatataagagcgttgttatcacgctctttttgttttccaagacataagccactaacaatctattccccttgcatatcttatagtatggaaggagatgaaacccatgaattcatgtaatcgagatttttgtatcgatgactgctgcatggacaattgctgtattgaaggttgttgcgttgatgaacgttgtgccttagcggctgttttacaatcagttgcaatgcaagaaggtgccttagctgcaattttatgtgctgaaagtgaaaaaattaaaaaagcagtatgtttagctaaatgtatcgatgaattaattgcaatcaatgaatcagcagcacagacaattggtactgtaaaggaactagaaaacgcattaaaagaaaaagcctgttgtgctattgaagcattacaagacctacgcaataatgattcttgtaaataaaaactagtctctggaatcttccagagactttataaatttaataaattagtagcaatcgtaaaatagatcaacaatgacaaagcatcaacgatcgtagtgataaacgggctagccatcacagcgggatcaaagcctaatttatcagctaaaattggtaaagtgcagccaacgattttagcaatgattacagtaactatcaaagttagacaaactacagcagctatcatgattgaaacatgatcaataatcatcattttaataaaattacatgctgctaaagtaaccccaactaaaattgcaactctaaattctttaaaaacaattttgacgatatcactatgtttgatttcatctagtgacaaagcccgaataattgagacagaagcttgcgaacctgaattaccaccagtatccattaacattggaataaaagccgttaaaatcacagagcccgctaaagcatgctcaaatccttgaatgatttttccagtaatagaagctgaaatcattaataacaaaagccacggtattctttttttaaatgtttcaaacgggccatttttaatataaggcttgtctgacggtaccattgcggccattttttcgatatcttcagttgtttcttcctgcatgatatcaacaatatcatcaactgtaatgattccaactaaacgattttcattatcaaccacaggcattgaagttaagtcatatttttgaaaatcatgtgctacatcctcttgatcctccatcgtatgaactgtaataagattatcgttcataatctcctcaatcaaagcactttgtgatgataaaactaactttctcaaagtaacaattcccaaaagatgacgaaaattatcgattacataacaagtattgattgtttctttatctactccaatacgtctaattcgtgcaatcgcttccttaactgtcatatctgcacgtaaatcaacaaaatcgatattcatattactacctgcagaatcttcaggatagcgtaataaatgatttatatcacgacgagtctcaggattggaagcagcaataattcgcttcacaacattagcgggtaactcttcaagaagttccattacgtcatctgaataaagatcattaataatattctctaactctttattggttaacgaatctattaacgcatgttctctgtcgcttgacatatatgcaaaaatatctgcagcatcatcttttggcaataatctaaatatacgtatcatattttcatcagaaaaaccttcgagcatttcggcaacatccacatcgttcatttcttttaagatttctttaatttccttatatttccttatttctaataatttttcaattaatttaatttgttccattcgactttccccgtttttcatatcattattaattataccaaagagtatatgctgatgaaagacaaaaggaagatacccacatcttccttcggtttctattaaaataatttttgtggataaacaccgacagctgttaatttttgaatactttcaataactgtttgtttatcttctttatatgtaactccaaaccaattatctaacgattttaacacagtcacttcaacctgattttcttttaatagtgaacctataatagttggtaatagatactcatctttaaaattatcattctctaattgagataaaaacaatttgaacttagaatctaaaatatcaaatatttctggttgtagagcccacatattcattgataccggtacctcgagatcaagttcaataatttgattttcttttttaacaaatgcacaattatcacctttttcaatattatgtgtctcaacaatatcacaaagatgattgttttgatcaaccgtgcacaccccacgtgttacaccaccattatcactcaaagtatttttaagtacaaaactaaccatcgcaatctgttgtttagccgtattatcatgattttcatttaagtatttataagcttcttcgtatgcctgtttaccataatagtcatcagcattaataactaaaaatggttcattaattacatccttgcaacataaaattgcctgccctgttccccatggttttgttctttgtttaaatgtttcttggtattcgtcaggaatattatctagttcttgaaaaacatattcaacatcaataatttgtttgattcgtgatccaatcacagcatcaaattctgcttctaaatccttacgaataacgaaaactactttattaaaacctgcctttttagcatcataaatggaataatccatgattatttcaccatttggtcctactggtgccaattgtttaatgccacctccaaaacgactaccaattccggccgccataataaccaatgtaatattcttcataaagtccctcatttctaaatattcttcattaattatacactatctttaactattttaatagttattgtaataagcaaatcgcagcaaacaaattaaagtagtattagtatcaatattttgttagaatgaatatcatggagggggattatgcagacttatctattatcaagaaaatattttaaattagcatttattatttatgcttttatcaatacacttgccctaggttacctaggtttcaatcttaatattttgttatttatcatgattggatggggaggacttatcattggatgggacttttatcaaaaacaaattaattaccatgatattaaatttattttaattattacctatggcctaattttgttccttgcaacagcgatcaatccatatagtaatttaaaatcatatttaattgcacttttacagctaatgatcttttttttaatctacgggaatcaaaaaagtttttcatcaaacaatatctacgatgaattaaaaagtattattcctctgaccaacctattaaccggtctagctggaatctgttctttaataatgtatttatttaaattctcgaaaattcaaaatggatggccaatcggattagtaggaaatcgattatttggtgtatattttaattgtaatcctgcagcctttttgagtgcaattactattttattagcactttatgcattaaaaaacgaatatacacatccacgattatataaactaaatatcattgtccaactattatatattattttgactcaatgccgagcagctctagttattttggctgtcattttgactggtttaatatatacttatttttttaaagattgttattattcaaagttaaagaaatatctattttctttaggtctttctatcattattttcattactagtatcatcaccgctaacggtctatcatatttaagtggtaatcatcacgaaacaagcagccgttttcaaattaataaagtaattgaatcaattgaattgttttttcaaggagattttcagccaagtttagatcaaattaatcagatcagcagtggacgtattgaattatttaatacttcaattgaaatttggcaaaccaaccctattttaggaattggtgccggtaattttcaaactattggtaggcacctgaccaacagtaatgttgtcaaacaaatccaggttgttcatagtcataatgtctttttggaaactcttgtaacaactggaatcgctggagcgagtctatttataatattttttattgcttcatttaaatctattctaaaattatttaaagtaaaacagcaaagttccaattatctaaagataatgatttttacattaattgttgttagtgaatttattggcggaatgtttgactatggcgttttttatgtttattctttatcagcaactctttgttggttatttcttggttatctacatgattatcattaaaaaagcttattcaaaataagggtgaaccctctcttaaaagctgagttgaattcaattcagcttttttgtaaagaaaaaagacgccaaagcgtccaattattttcttaaacctaaactttcacataaagaagaatatctttcaatatctttattttttaaatattttaataaatctcttcttctaccaactttttttaataatcctctatttgaatgattatcttttggatgttgtttgaaatgtccatttaatttgttgatatctgctgttaatactgcgatttgtacttctggagatcctgtatctccttctttagtagcatatttttgcataatagctgttttttctgctttagttaacattctaattatcctcctgttgtttaacttagctaactccaagctatacgtcgagtactcgtatatcctagacgttgccgcgaataatattctatcaaatatcttcttaaagtcaagttaaatcactaaatatttaaataaacttatttctttttataattccccgattgataactgctaagattgtaaactctttatctatgacaacaatatcaccctgataaccaatttctatcttcccctgctttaatccatataatttagctggattaactgccgccattagtacggcatcatcgattgaacagtcacaataacgcatcatattagcacaagcttcatttaaccctaatgtgcttcctgcaattctaccagtttctttgactgtagcatgtcccccgacaattacaatatctttaccagaaaaatgatattgcccatctggcaatcccttacagggattagcatcagtaatcaaaataattcgctcttttccaattgctttgtatgtcgcacgaataacatcttcatcaatatgaaagccatccacgataagctcacacattaaatctgataaaattgcaccagttacaactccagggtcacggtgcaaatgctgtgacattgcgttataaagatgagtaattccttttgcaccgtatgcttgtgccttttttacctctttagcacttgcacttgaatgccccacattcatcacatagccatggttacttgcataattgattaattctaaagcattaggcagctcgggggcaattgtcattgcattcacttttctgcaagttgaaatatactgattaaattcatcaaaatttactaaacgtaaatgttcttctttcattacacctttattcttaatatttaaatacggtccttcaagatgaacaccaattaaattatctggggtatttccttcatacatttgtaaaagattcaatgtgtcgtgatggctttcacaaacaatactagcgttaaaaccagtaactccctcatctaataagctatcactgattatttctaactcctgctttgatgaatacttattaaaatcatatcccatcgccccatgtgtatgggtatccaaaagaccaggaataatataattattttgaacatcaataacactatcagcttctaatccttcataatctttataaatacctgtaatctttccaccttcaatcatcaccgcaccgttattaagccgtttaattccatcaagaatcacaattccatttttaattaatgttttcatatcatgtcccctttttccgtataaatacatatgtttccacatctgataatgcttcacaatattgataacctaaataattaaattgttttactgcctcaaatgaatcaattcgattttcaattaaataacgaaccatttgtcctcttgccatctttacataaacacctatttccctatacccttcatcactctcctctttaaagtggcatttaacatattttatgctagatgttaaatatttttttatgattttagtatattgttttgccccaagatctagtatttgattatcatcttttgtcaattcatcataaattcgactgttccaaaactcatataaacttttaaatttttctgtctttactttattatttaattctaaacgatatggcacaacaccatcgaacggtcttaaaataccataaaatccagataagatgcgtaaatgttgttttgtatattcataatcatcatcagttaaaacatgagctgccgtattagtatattgaattccttcataagctagcagtgctggaactgtgtccttttttagatccatcatctgataattcaagtatgcaatttgagcaatttgatcattgcaacctaacatcttttttacttcatcgacttttagtgtcttaagaattcctagcagttcctccgtttgtggcaaaaaaacaggtaaactttctacgtctatataatcaatattatcgttcatccgtttagctggagtaattacaattttcatttaatttccttattataactatctttaagatagtagcgtctttttccctttgtcttatttttatactcaattgcagcttttggacaaatactgatacatgccatacactgtgtacaatgtttatcccaaataggtctagaatcaactagactaatgttctttaatggacaagcatggatacattgaccacaaccaatacaagtatcttcaacatgaaatcctttagccctaacaaacattggataaaaaagcctattgactatgccactattaaatcgtcctataaacgtaggtttagtttctaaaaaatattttcctgctttgatttcagctgctagtaaaagtgcagtttctacaccatgtgaaataatcacttctggattttctggtgccttaaacatagtaataaaattttctggcataacaatctctccgactcccattaaaatcatatttttttcattacataaacggttaatatatttagcagcatttccaatatctccaccacatgtcattataaaataaattttagttcccgaaacaaaataaaatgattagtccgaataaattgctccactacccgaggaatacgccacgcatatgtagggcaaacaataatatactgctgctctaatgaaacaattaaattattttttaaacattcattgatagaaactaatttatcttcaatcactgaattaattacctctgcaatatatcggctatttccagtcccgctaaaatacaaaatcattaagcaatcttcctttcataaatattttcatatcttcccgagcacgtttttccacaatcaattattttaaatccaaatttttcatataaaccaaattcactactatgtatatatatttttttaaaacccatttttcttgcacatacaataatttctttaatcatcacttcacttaaacgttgaccacggtaattcggattcacatagatatagccaataaaaggctgatagccactattatctatactatcactttcaacaaaagtcgaaaaaccaacaattttattatcataccaaatcccaactacacactgccatttagtaaaataccctgtcttcattttattagccaaagatttaccagcacgccaagaacaattttgaacatagtcaatcattgtatcccaatattcatccgtactttttaaaaatttaatttctatcattaaatccctcccatcaaaaaaagaagatcttatcaatcctctttattataacatcatatagattgcttgggaaacaccgtcttcttcacatgctccaactacctgataagccattgctttaattgtctcattagcattacctggcgcaaaagaatacttaaaccgctcaaataatgtaatatcattgagaccgtcacctaaaaccattacttcatcttttgaataacctaattcttcaataacattttccaaaatcaatcctttttgagctgccttatcggtaacttcaatattatcatcaaatgatgataaataagctatcccctcaatttcctgaagtttttctttagctttttcaattaatgatacatcattattaaatgcttcaaccttaataatatcaattgaagaattaataaaatcatctaagtcacctattttttttaacttcatacacgccatatcttgattacagccatcatctaagtagtcctctcgtttgcgcttgaactgaacaacacagcgatcaataaaagcatcacgaacaacatttggctcagctgttgaataaaaaccattcgcagtaaaaatcatataatgaatctttagttcatcaaatatttgtaaaacttgtttaaaacattttttaggaaaatatgcacttgataaaatttctccattttcattacaaaattgtgctccatttcctaaaatgctaaaacattttaaatcatgtgcctctaatatccccttaaggcttgaataatcacgcccggtagcaattgcaaattgcactcctttactttgagcatacctaattgcttcaatatttccctttgaaattgatgaatcatgcgccaatagtgttccatccatatctgatacaattaattttatcatttttcatacctcatacctttaataaagtttatagttctattgtatctaatcttttgaaacattaaagatattttctcaattagaaatctttatctaaaaaaccgttaaaattatcttaacggtcatgttttaatttctattttaaagtattaaaaacaattcggttacgaccttcttttttccctcgataaagattatcatcaattaaattgatcaattcatcaagatcattgtattcattagaatccgctaagccaaatgtcattgtaatcttaactttgtcatctttccaataaatactctcttgataaatctgttcttgtaagatttctaaatgcttaaaagcctgataccgatccatatcttcatagatcaagacaaattcttcaccaccccatctaaatacaaatcccaggtgttccatatgggtcgaaataactttagcaagttgacgtaaagtttcatcacctgcttgatgaccatatgtatcattaacatatttaaaaaaatcaacatctcccattgccactgcaaaagaagtgttcttttgttttacacgctgaattaaactcgctaaaaccacatcacaactatggcgattatgtaatcccgttaacggatcttttccaactaaatcactaagagactctttcatcataaccgcaaaacgccccatatcaccaatttcatcatgacgctgtaatacgtatggatctatttcagtcgtcaaatctccatttgctactgctcctaaaaaatgttttgttgtatttaaagcaaaaatcgtttttttactataataataagatacaataattgcaattatcataattgtaacgattgaaagagaaacaagataaatattatgcataatatgattcataacatcagcacgtggacgccccataaaaagcattccaacgacgtgctgatcagtattttttacgggcatgtaaaaaccaaaataactactatcattaattacaacagaatctgaaaaaaattctttatcattatttaaaactgtttcgataacttcatctggtgcaatcgtatcaacaactcttttgccatcttcttgacgaattgttgttagtatgcgtttatcttgataaaacaaagttgcatcgaccccggtattatttttaattaaatccaccaaattaaaatcattttgaatatcttctgttcccttatataaatggttattatttaagtaataatcacctggatattgcatgtcaaagtcttgatatgatactctagccaaatcttcaagattattagcaacttcgccctttaaggcagtataaattaaacttgaggttataaagattacaaacattcctaaaatcagtatcggtattacagctaacgacattacatttatcgcaaattttctcttttttcgtttcatttttttatccctataaatgattatttctgtttggtttgttggtatctttaataattgtatcacacaagccatattaggtaaaatcaaaaataaaagcatggtttcaaccatgcttagctataaccttaatttaatatattttatctgcaatcgcaatcactaaaaaaatattttatttccataaataatctagatatatttgattttctaactgccaggatgcttcattatgctgacctttttccacaacatttatataactagatgcattactttcaatcagtctatcattaaaatataagatattattcaacatccattgaatcccatttttccctttgacctcatcagttccaaaactaaagtatacccgcgtatcttccatgattttagcttgagtatattcatttttcaattcttccatacacattgaaatcgatggcgatatacaagctgcttttgaaaaatacttattgtaataaataacagtataaaacgccattaatccccccattgaacttccagcaatgcctgtgcattcacgaaacggataagtgcgatacttttgatcgacgagaatctttaattcgttaacaacccaatccatcaatatctttccttgtccattgagatgaccaaaatatttactttctatttgatagggacaatattcacttaagcgtttttgtccttcatgattacattcaattcctacaataatcaactttttatcataggtatcaagaaattcctttagtccccacgattttccataagtagcatcatggtcataaaataaattatgtccatcaaacatatacatcactggatattgttcatcactatcataataatcttctggtaaatatacatggattgttcgctctaatccaagtggtgtgattactatatcaaacttttcaaccataatgtttcctcacgcaatagctttaataaccaaaaattgctactgctgctttcattttttcaataatcttaacattgaatgggcaattttttatacataccccacattcaatacattcacttgcatgatgagctaaaacttcataatgttctctaactgtttctggtacttccccttgagcaacacataaatctgcaaatttatttacatcagctatattaatgcatttgacacatggagcacaatgtccgcaatatacacaatttccttcaaatgaatgttttggtatattagctaaaacattagcaaaatctttttctaccatacttgcatcttcataagctaatgcctccatcatctctttaatactatgacttcctgccatgatcgaagctactcccggtcgcgttaaacaataatgaatacactgtaacggtgtcattttaaccttaaacggcgataacttttcatctaataaatctccccctccaaatgctttcatcacagttaatgcaactcctttagtttggcacaattcatacaattcttgacggactggatcaatattaaaaagcggttccgcatacctttcatcatcccacaaatcatcaacattttcagatggaggcaacatatcataacaaggattaattgaaaacagtattacatcaactaatcctgtcttaacagcttcaattgcaataagtggattatgagaactaattccaatatgtttaataattccacgtttttttaaatcctttacatactcaattacttcaccattaaaaacttcttcgaaatcttttttagcatcaatgtaatggatcattccaatatcaatatagtcagtctgcagtcttgccagcaaatcttcaaacccagcttttacttcatccattttacgagttctcaaatactgttcatttttccaaaaagtacatatatgcccttcaataatccacttttcacggttaccagctatcgctttaccaaaagcactccgcccatgtgggtttgatgaaaaaaaatctataaaatttattcccatttttgaagcctgagcaacaaatttcttaacttgatcagtatccattttcataaatccttcacagcctaaacctatttcactaacttttaaacctgttcttcctaattcccgatatttcacttttaccacctcaaaatacattgtactacctaaagtgaactttaggtcaaccattatttatgataaaaggatatatttctgtaaactatcgtctacagaaaagacataaaatataaaggaatgctatcaatatattatttttgtacgaaaaaaatgtattagacacggaaataattttttacagaagaacactattaaaagcgatagttcaatttattattaaaaacaaatatcatttacatatagaaaaagtcatgaatgtttattcatgacttatcattttcgtatttttaataagagattaatacacccttaattattaggtaatttcatcgagctctgtaaatcattataccataaactatcattgaaccaaatgtaataattagaaaaagcggtgtaaaccattttggcaaattaatcagcaaagtcgtatacagtgttaaaaacataaatattgtggtgatacataatttcagggttactatcattccttttattaattgataaacatgtttttgattttccttagtaatagctacaccagtattccacgttttaggaaaatgttctattactgataatcccgcaaacattatgattccaacaaaataaactatccatagccctgacttacttgtccatcgattgattactccagcactatcataatgtcctggaatttgatccgagatcatcgtccaattagttaccaaaaagactagtgttcctgtcaatattattatacaaagaagatttactattttatgatatctagttgaaggcactttaatttcatccattttaatcacctcttacaaacaatattatactcccttgaaatatcactttcatcattaatgataagtcatcatcttattttaaagaatactgaaatactgcagtgcttttaaaattccatcttcgtctacatc
